United States Patent 9,567,581 (SELECTIVE REACTIVATION OF GENES ON THE INACTIVE X CHROMOSOME) - sequence listing, part 57

SEQ ID NO: 5760 - DNA, 784748 bp, human
gaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaa

SEQ ID NO: 5761 - DNA, 133235 bp, human
atttcacaatgtgaggatacagcaagaagtgtcatcttggaagcagagagcaaacactcatcagacattaaatctgacagcaccttgatcctggacttcccagcctctagaaatgtaagcaataaatttctgtcgtttacaaattacccagtctcaggtagagcagcctgaacagattaaggtttcaacatgcttgggtttggtaaataggtttgcatttatcctatccaaatgtttatgatttcttgatttcaaaaacactgagcatagcctctgcatccttacactgtagaatggatgaacattgtgtcctcacatggcaaaaggagtggaagggccaggcagctctttgaagcttctcactcaactattatattttccaagagaagagcactaattgttttggtctttcataacagggaattttcacccatttttacttcattacaaagggccttctctagcctgatgcagcagcctgtttttaaacagaagcagcaatcagaattacttgcaataattcatcctgtctggaggaccctaatcttgtactaaggaagtagaatgtcttctgttaggatgccaatctctttcctgagactgatctgcagagtgtggaccattgtgattacaacaccttcctgagctaattttttttttttcacagaatggttaccagtcactcctagatccctttttcaagtttgaaactgagaaggcaaagcctgccagcctgtgaatgcagcctagcttctttcactttcatttttcactaaatgctttaccgtatccacacgaagctcatctgccacttctcggcccactcaggagcctcacgagagcttcatgcagtagatccctggcagcttggcatttcactttcagtgaactcagaacagctgagtgtaaactgcaaactctcctactttagtttccttaatttttttattgaggcctcagagtaattaaactgataacgtatggagctgagagagaaatattaagtgtaaaattatctgccaattaaaaaaagcaagctccatgctatgatagtttttttctttttattaaaaaattcacccttcctcacagtgatgatgaaaagtaaataacataagcctacatttagacatgctactgacctctcatacctctgaagggataaaactgaaggattaatctgccaaacatcctaaaatgcatctactttcattgtcatcattccctccaattggtctctccaggttgatttgtaattctatatgcctcgtatatatttaaagagcctaatgtttatcattacttcatttttaaaatttttatttcctactctaggaaaccttattaatttttataacactcccttttcagattacaagataaataaaatagatttctagttttctcagatatgcttcaattgtatgagggcttattataaatacagaaaaaaaatcaattagcagaattctaattttcctgtggacatttcaacagaaaataacaaagattgtgaaattctattatagctattttactacataagggaaatattatcctgagggctttttatttttgccaaatacaaagttaatttgtgcaagccaaccatacatagatttggggggtatctttgttaatttgtaccacaaagtggtggtgttggagtaggtaataaccttggcattctcctcatctatagcctagaaaaacacccattgaactatagggtgttcccttaatatctaccttagttttaagttctgtcctgaacacagttcacttttgtcaattaaaattcccgaatatttcccaatcccataagtagaagcagcacgatatagtggagagaacaccaaatttggactcagagaagctttaggctcaaattctggctcagcctcatgcaagccaggaaattaggagtaagtcacatggcctttcttaattttttttttgagagggagtcttgctctgtcacccaggctggagtgcagtggcgggatcttgactcagctggaatgcagtggcgcgatctcggttcactgcaacctccgcctcccaggttcaagtgattcttctgcctcagcctcccgagtagctgggactacaggcgcacgccaccatgcccagctaatttttttttttttttgtatttttagtagagatggggtttcaccatattggccaggctggtcttgaactcctgacctcaggtgatccgcctgcctccgcctaccaaagtgctgggattacaggcatgagccaccgcgcccggccatcacatgtcctttctaattctcagtctcctcacctgcaaaatgaggagagtaaccctaccttactatgttcacacatttcttgtaaggttcaaataagatattgtaaaattaaagtagtttataaacagtagtttaccaggtaactatacagttttatcataattggctttcttaactgcaaggtttatttacagatagaccctctttcaaatgggctaatttaatatattctaccgttggctctgtatttcatactgtgatcctttgaaaaatattcatggttttatgactatatccatagtaaaaacaaaaatgtttccaatgccatcttaacaatcagcacagaggcaatagccttcttttcattttacattttctttctagttctggttcttcagcacaagccactctgatgatgtttaaaaccaaaatatcaaatgacactgtcatgatctggaaatgtctgcaaggtccaatgggaagtcttagcaaatgtcagagtacctctaaggcaaggcagatcctcaagatggataatgattcaggagttttgtactaaagatacagcagggtgctggggaaaggcctgtttgatgctcaaaggttaagcagcacaagtttaatgcctagtaaagtaaaaagtcacttagcattgtgattagtgatgccaaataggtacagggcgatttaaaagagagacagtcaacaaacacatttcaagaggtgtcaaaatggatattttcatcctttttcctttctctctgacaagtaactacttagaaaagccaacaactgaaaacacatcacaggcagcagtcacctgtttgtcagtagactactgttgttgagttgcatttttaaatgcatcacagtggatgataattcacagacattaaaggaagagaaattatctctacatatccattaagaatggtcctactcatatgtctatcactggcaattcaattgttgatttttctttcaaagcaaaacaaatacatgtatcaagacagtacagaaacctggaagaggaattgatccaagtcagtgatactaaatgaaatgacacacatcattaaatacggcagatgcctagtgataagcactaaaagaagggggtcaaagcgatatccaataacaacaaaatagtctcagaagcagaaaacttaaaggttctctcccccttccccccagatgcttcagataactctagggaatgctgaaatgcatggtaatgtgtgaaaattagccatctacattcatgatatgaagtacatgtcatggttagcatatgaaaattcttgttaatgtaatggtccattctaggatatgcagtataattggagctggacttaaggatttctcatgtggcatcatcatggtctcaagaagaaagtgaaatctaaaatgacacatttgggctgggcacggtggctcacgcctataatcccagcactttgggaggccgaggcaggcggatcacctgaggtcaggagttgaagaccagcctggccaacatggcgaaacctcgtctctactaaaaatacaaaaactagctgggcctggtagcgggtgcctgtaatcccagctactcaggaggctgaggcaggagaatagcttgtacccaggaggtagaggctgcagtgagccgagactgagccattgcactccagcctgggtgacaagagtgaaactccatctaaaaaaaaaagaagacacagttggaaaagaatatacacattaatatgtttttaaatctggccagagcatgaaagaatttacaatttactctcacagctaactggctgttgaggggtatacggtagtagccatctgaggtttatacatggtatactgcaagctactggaggacttgtattctatatctttgtatttcttaatacctaacatggcgcctgccacaaagcttgtggccaaaaaaagtaggttgaattaaacttacagaaactttgctctcatgggccttaaagtcttgtatacagatgggaaatgatcaaatggcaaatgagtaaaaacagatgctagaaatgtagatgagaggtggcagggatctttttaatacttgtatctctggatctagtgctgttcctggcatatgggtcaccttcaggaagtgttgagatatcagtgtgtcacacagagaccgtgaaatttgatctaggccttgagacgtgggtaggattggaagaggtttgctcccaacccttcttaacagcaatttctaatggaactagagagggacatagctcctctaaccccatacaagtttatatgtgtctcttctttcttaaagcatgatgtctttttccatgaagtgatacctatcccaatttctggtaggtcaggattatataaattggggctggaagtcagaccagaggacaaatgccagtgaacatctgccttgctagagactatagctacttttgactttgaatcttcatggttttatattgtctgtatttttttggttaaatctttactttgtttttgatcattttaattcaacagatatttaccatgtctaccgtgtacgtagaaacgaaaagtgaacacataaaatagacatgtaagactacactatgaatgcttttagcattttaagaaagttttgaatgcctatatttacagtaaagactgtgagttgtggtgactcttgttagggattttttcccactatcagactttttttttttttttttgagacggagtctcactcagtcgccaggctggagcgcagtggcatgatctcagctcactgtaacctccgcctcctggattcaagcgatttttctgcctcagcctcccgagtagctgggtctacaggcgcgcaccaccacgcccagctaatttttgtgtttttagtagagacagggtttcaccgtgttggccaggatggtcttgatctcttggccttatgatccacctgccttggcctcccaaagtgctgggattacaggaatgagctaccatgcccgacccggactgttttatatttctagaccaatgcaactgaagggtttcatgacatgacagggagagtcatttgaaccgttattgtttacaacttattacagaaaatcagaattgtctcaatatagtacggtaataaatacagatgctccttgacttacaatggggttacgccctgataaacccaacagaagctgaaaatgtgtagctgattgggagctaagcctcaatgttgctacccagcatgatgagagatgtacaatttctacttgaatgcatagtgctttcacaccattgtaaagttgaaaaatagttgaaccatcataattcctaactaactgtgtacagatataattttgatactgagtctaatataacacaggtgctgtagtctataacccccaatttgacacttttgagtttgaagtagcctgttttcatttgcataatatttatttgaaagaaatatcactcttattttatctatcttggttagatgtaagattttctttagaaaagttttctctgtgttaaaaaaaaagagaaatgtttgaaaaccactgctctaatttcttcttccaaattgttcccagaggtctctttctaaaacccaatttcatcatggccctcttctgcttaaatcagtggatcgtacatcatataaaagttctaactcctttgtatgagaccccttactggctgctggccaaccccccagcctcatctcctaccttgcctcctctcatcctaaccaaaaccacacggacttaattttttgcagttctgggactttggcttagccttcatttctcctaactttttaaagcattgtgcctgatcccttggatcctcactacactgtccagtttctttgtcctctaggaaaaccactttttatccttcaaagttcgcaagctaaatataaagccttcttcaacaaagagttgggtcttccactgcattcacccaagcaccctgtatgcaccaccattatctaactcaacaaactttaatgtgtttctttgtttccatcttggtctccccaactagactgtgagttataagaggacatgaatgtgcccttgtcatgtctttgaattcctgctacttaggacataatctcgttcgtagatgttaagtaatatatatttgttgaataaataaaaagtgactaattcagaattcatgatagttgtctaggaactagcattgacatttaccttggtttagcaaactccttccccatagataataaatagtataactaacatgagtaatatttaaaatgcttaagagaacaaacttgtcaaatcccctcaagtactttataagcttcaatttacatacagttgatatgccaattataatttagctgtatttgtttattaagactgggtccttaaggacacctactaggcaatggtttggatgactgaatcttgttaacttagtttgagctcctatgcatcctaaaaataaattaaaaagcatttccttaaaattattctataattcaaataattttctcaaaatcaaaatggcctttccaaatttgcaagatgctttattaactactgtttcacttcgttttatactactacttaaatacatttattgttactttaaggattaaaacacatccccaagagtcttggcagagacattctatgttataaagccccaattctttcgctcttgttgcccagactggagtgcagtggcacgatctctgctcactgcaacctccgcctcccaggttcaagtgattctcctgcctcagcctcccgagtagctgggattacaggcacctgccaccacacccagctaatttttgtatttttggtagagatggggtttcaccatgttggccaggctggtcttgaactcctgacctcaggtgatctgcccacttcggcctcccaaagtgctgggattacaggtgtgagccaccgtgcctggcctaaagccccaattctttgagatgaaattgtacaggtcctctgccgtctaccatctcctgtttattctcttctatgtattctgccgctccctacaactaaccctagactccagttacaccaactccttccctatcttgaaagatacaaagtcttttcatgataccatgtttttatacatatttttccattcctctgcaatgccctttgcatactcacaactatgaattaatcgatgaactccaatatcctttaccctataactcaaaaggcagcttcacagtgaaacattttgggcttcctgagacaatgttagttgccctgtttttctgtgttcccatagcattttgttgagacatataatttaatatttgtgacactataattgtatatttatgtctacccctatttaaatgacgtttttgagttcagagaccgcgtattattcatctttctatccccagcatttaggattgtatttggtacaaaaaaggtacctgttgtgggttgaactgtgtcccccgaaaatacatgttgaagtcctgacccctgttacctatgaatgtagccatatttggaaataagtttaatccagtgactggtgtcattaggggagagagatttggagacacagagggcacacagaggtaagaaggccatgtgacaatgggggtagaaattggaatgcaaggaatgccaaggtttgttgggaaccaacagaagataggagagaggagagagacatggaacagattctccttcagcgccctcagaagaaatcaagcctgctgacaacttgattttaaacttctagcctccagaaatgtgagagaataaatttctgttgttttaagtcacacagttcgtggtaatatattacagcagctctaggaaactcatacagcacccaatacatttttattgaatgaataaataaatggatgatgaacaacttaacagaggagatccttttactcagtagagactctatgttcagtccagtgaattcttcaaagggtctaacctaagtttctcagtccgcataagagagagtcccttgataacctccctgcatgtttaattccatgatgattccggctgcagggaaggggacagtcataaaatccacaggcaattaactgtgtctctctaccataattcccactgggaacagaggggagatcttgaggccacagccaaaagatttaggatcatgaatgactcactgaaactgcttctctaccaaagttttggctgaagtgttgtgccctaaaatgggccatctaatgctggagtcctcatgagaatgttccccggtctgtggtagaatggtagagtaactgcgattggcgctattactgttgttgcctaaaagacctattttagggtaagtttgtaacaaaaattagagcaatagacacagtgtactcatatttaaaacctggtaagattttgcttcttagccatttcattaatgtagtctttgctaaacaaacataaccaccatgacaatcatctataaccttattatttacaaaaggctttgacacagagttttatttaaaatcagtataaaatcatcttttactcattcttttcatttaaaagttccttttctaccttactatcttttttcccatactgacattgatttccctgatttttatctgaaatccttttcttcatctgtttctaactttcttcaagttttctcccactcaccctatttacaactacagtccatcatgttcattataatgatgtctctgtaaaaatatttcaactctcacctttgcagctagctctttcttcttatctccttcacttaaaaactgtagagtgaaataagacacaaagttgaaggtaaaagaagactgcatttcttaaaggctgccatataacatctttcctgaagaatgcagacctagtttgcagccagtgggtatgcaactatttccttgtgggcactaaagttatcaccataatgaagcaatagaactcattgagacccatattctttctttcttccagtgatgggtttaagtcaaaacagacacagatgagtaatgacagggtctaaatccagaaagagaaatatattaatgatgcagacactagaaacacagactgtaaaccactaaagaaacacacataccaaatgttccaccagcctgtttttttttttttttaatctcttcaggaaacccttggctaaagccaattcataacacttggtctgctggcaaaacccaacatgaacagtaaagacctacagctgccttgttgagagatgtctattaggtttatagtcactcttggtctggaagacctgtgtagagtagactagtttgtgggccagcgttgagacaccaggcattattttattttatttatgtagtacacacttatagtaagtgctatcacttactttgtaccaggaactaatctaagcacataacaaatatgaataagcttattcttcataaccttgggaaacatataatctgattatcattttacagatgaggaaaatgaggcacagagaggtcaaataatttgcccaagttatataagttgcaaagccaggattcaaatgtaggtattcctgaatctgtagtccatatactaaccattattctatcttgcctttcagtgagttcctgaagcttctagactaatgtgagtccagagcaggttaggtctttagcctttctcattttattggattatgggttcatttcaggattccatcagccttcatgatttattcagtgtataaggtatgggaaagcttatagcagatgctgctgaagttatatatggaatgtatgtagcctttgtcctgtgagaatttaacaatgagttaagcataaaggccatatgtagaccagagaaaaacttaaggatagttacaaagctttatatgtatcaagagattgctcaagcactgagaggagaggtaggaggggatttggatttctatgcaaaaattcccccataggttagaagtagtatctgtgaggcaatcactggacgtgctgctatagatcatatatatctgcttacagaaagatgtaccatttgaggctggtttctctggctgactttgctgttctagccatcatgacagcagaaccagctgttagttcaactacacacactgttgtagtgtaccaaacggaggctggagaatatgaaaatgaatgtgaatatgtatacatattatgtatatgaatacatacatacatatattaatatatgcacatacatatacaaggtacatatacatatatacacatgtactagtgtatgtctatctatgtatataactagaaattgttgagtttagtataaaccaggtatgtgctgagtgctttacatgaattattttattatcacatcaagcctgatagtgagttattaagtaggaagagtcaagatacaaaccccggctgtctggcaccattgccataaaatctactgcttatcatttgagttaggccttaagctttctcatacttttttaaaactgttttgcctttatgctttcccagccattttcttcttcttcttcttttttttttttttttttaacctactcactgcattaagttttttaaagccagccagagaacacaatcaataatttggtaaaatgtcaaaagctgcaattttatctttcagcattgggctacactggacttgaatacttttccctcttagcatttctatttcaggtttaaacaactgctgcatatacaatatccccagtaaaacatccattatgtttgtaattaagggggtattagaagttaaaggcaataaaatacatcatttccatgccaaaaaaattcttatcaatacagagtatgacaaaatgtctggtttattggcttatctgtggtatgtgaacaacatccaattctctgttatgtttaacaaggaaaaaaatcaaatgctataaaaatgttgtgaatatttaattaattagggtgtattttgaagcaattcatttcacatccttggcacaatgtgataagctgatgcaggtgtaagggaaattgtacaaccaaagttaaaaatacattcagcacacaaaacagtagaataatataaatccttcttccttattataaagataaatgcagtattatgggctgaactgtgtcttccccaaatacatatgttgaagtcctaacctgcagtacctcagaatataacagtatttacagatagggcctttaaagtagtaattaagttaaatctgactggtgtccttagtacacagagcatagagacagagggatagtcacattagggcacagtgagaagggccaaggacagagggctcagaagaaaccaaacctgctgactctttgattttggacttctagcctccagaattttgaggaaattaatttatccagcttaagccaccaagtctatggcatttattgtaactgccctagcaaactaatacacgtagtaataactaagtcaacaactatttgcagaccttcaaagttctatgacttaaaagttatttttcttttgggttgttcatataggaacacatatattgcttttctatatgcagttatactatcattaaaacaaacaagcaaactccagccatctacctagccatttatttttggtttatcttatagtaaaaaaaggaaaaaaaaaaaaaagaaaaatgtgtatattcaaaaacaaaagagtaatgagtgaagagtgaaatgaattaaatgttgaattttgaggtgttgattccagagcataaaaacctattcctcagagtaggtattctcaaatacaatttagccctgaaaggtatgattccatccatttggaagtccagtacttaattgaagctgtattacttacttattcagtttattagtttatctgttttttcctatgttgacttcttgacttttcatctgaacttttcatgttcttttcactaaacaacttagtagggttaagatatctagtttttcctttctatggaatatggtacatagctcaataagtatttcatcaagaaatgaagggaacttttttccccttaagtggctttgttaattcctatactcaaaatcattgagtttacaacttaggagataatgcgaagatcatctagttcaccaacttcatttcatgcaaggggagactcctaaggctcgcagagtcttagtgatcagatcacgatcacacagttaccagctagaatgagtcttctgatctaagtctatgctctttccatgatccttagctgagtcagtgctactttcacaaatcacaaagtcagaaatgtttcatgcacaactgtggaacagttgactaattttccagactttgaggtataatttgttggctctcatcttcacaatgccagtctggagaataaggagaaggcaaaaagagatttcttaaaagtcttatgaattaagttatatgtaaatagccagtatgggagacttcatacttcgggaataatcagagtgagatatctacctagatcctcctaaaaatagtattacagaggaaaaaaggagaaaacaaccaattataacattcctgctttactgaatcataatagtgcaaattttatttaattttaatttttaaatttaattttaatttttttttttttttaaaaaacggagtctcgttcttgttgccctggctggagtgtaatggcggcacgatctcggctcactacaacctccacctcccgggttcaagcaattctcccaactcaatctcccgagtagctgggtttacaggtgtgcgccaccacgcccagctaagttttgtatttttagtagagatgggttttcaccatgttggccaggctggtctcgaactcctcatctcaggtgatccacctgtctcagcctcccaaagtgctgggattacaggcatgagccaccactcccgaacactgcaaattttagttttcaaattcatgcagactacaaccaggaagtgatggtaatattgtttatcataaccgatagctgtgacaaacctgaagccaggctttggctgcctagtttggtgttaccaggcaaaattgtaaagtaggtggccttcaatctattttttcatacctctcccctgcctccttaatggctttttaaaatcaccttctatgtttacataaaaatttaggctaacaacgtttctctttgactttcaaaaaaaaaaaagtctttttaaaaacatacttaagcattatttttaattgttcctctttcttagaggaaattaaaaatgaatgtcctctgtggatatacagggccctcatgctactcctaattcccttgagtaggggctcaaacaggccctctcaccaaagacctcttgctctgcatgtcttctttcattcacctggctcctcagtaaaatgttccattccctcacaacccacaaagtagccagagaagagtagttaaaataaaggtatgaaatattgatattattagctattctcatttctattttacagacagatctggtttaacttaatgcagcctgagttggcagaggttatttgggaggtcttttgggcagaggaatcttcctaatatcccttgttaactcctcagaagaaaggtttttaagaacttcacgtgacatttagatctctcctctagatttggggctcagagttaagtgtctttgtcatatgcatggcagtgggagatggtcatgaggcagaatgtaagaaacatacccgacatgtagctaaatgttcttagcttaagagcccatgagagaaatagtgctcaactccagaatgaacaaccaattgtctgaagtctatatatgaaagaccagattgtccctaacttatataatacatattttatttttatttatttatttgagacagagtttcgctcttgttgcccaggctggagtgcagtggcaggatcccggcccactgtaacctccgcctcctgggttcaagtgattctcctgcctccgcctccggagtagctgggattacaggcgcccgccaccacacccaggtaatttttgtatttttggtagagacaaggtttcatcgtgttggccaggctggtctcaaactcctgacctcaggtgatccacctgacttggcctcccaaagtgttgggattacaggcgtgagccactgcacccagcccatattttatgtaatactgttttttgaaatagccattctatgtttaaatgaaaccttaggctaagagcatttgtctttgactttcaaaaagaagcctttattttaaaacatacttggggattattttgaattgttgctctttcttagagaaaattaaaaatgtagatatgcctatgtgcttacttggagatgtactatagctctaaaaactataatatttttaaagagtacaggtaaattatcttgtagaatgcggatttgcttgatgtttcctcatgattagattcaggatatgcatttttggcaggggaactgttccagattaaaggaggttgaagagccatgataactaaatgcaacatgtgggctgggattttttttctcttactatagagaatattagtgggagaactgataaaatttaaataaagtctatagattaagtggtaatttatcaatgttgatttaccaatgttgataaatgtactattatacaaaagaatgttcttattttgaagaaatacacacttaagtattcaggggtgaaggggcatcatgttgcaatttattctgaaacattcagaaaaaaataatgtgtgtatgtgtttctagaaaaaagattaataaaggaaatgcagtaaaacattaatatttggggaatctgggtgaagggggtatcaaaatctggactaaccttgtaacttttctgtaggtctaaaattatttcaatataatttttttaaagctataaaatagtttgaatgtgtttatgcacatgttagattactcccaaatttacatgtatatttaggcaaggagatctgaaaggcaaatttcaacctgaaactttaatttctaagatctacttcacagtaaatcaaacccaaatgctgaagctatttagcaagcctgcctgtctacaaattggatcacagtgaggggaatgaaaggaaataaattaaataaaaagtaagttagtcacaaaatgttataaattagaaatgttttaaaattagtttctttttcttttcaaatttagatgataaaatattttatcagcacttgggaaaattacccgtcattttataaatgggcaggcccttaatgtgggccttaatatacaaataactgcaaaattccaaaatacactctcttttaaaagtaacaaatatattaattcactttatatcagttgcaaataagttagtactttgttaggacacgtctctagttcctactgtgacaagaaaaaactttcactgcaatataatggtttaaagtaatattggtcaattaattaaatcaggccatattccagaagaccaagttatattagactttttacagataatttttaaggtatcactttgcacagagaatacaagtaaaagtatacatgacacatacacagaaccattcataagaaatgaaaaaaatattacattgctttaaaggcaatgtgaactttgcagagaagtggggttgtatttaatctccagtgcccacatcattgtacattcaattaaattagattagaaaactgggccatgtcactgagtgctgatgccttttcatgattcagaaaagcaacatggcttgtggaaccctcctgacatgccattctttctagccaaaggccatccctgctctttagagcatattcagaaatgaggcacaaaatgaaaactcacaacaaagagccgcagaagagtcatggagagtgagtcatactgtttggggcaggctgtatggccatgtaatcaggaaagaagaggggaacaaattctttagattaaaaatgaccttaaaattgtgcatcgaccaaaaattgtgtgtgcataggtgcacaagagagagaaagagagagacacacacaaaataagaatgaatgaatgaatagggaatttgactttggattgcacaaggtatcctcaggtctgctcttttctctagaagggagtagtttctgttgtcagatattagagcatgaacttggacctttcccagtggtcacatgagcattactatcagcactgtttagcccagaccagtaaacaggaattgatgctgaactcattacaacttagtcccgacaggcttgatatttatggagtgcaaatataaatgagtttcttaaatagggaaatgatatggaacaacacaaagatcaaacaaagggttcagaatcaggcagatctgggatcaactcctaactctatcatttgccagatgtatggccttaggcaactaattgaacttctctgggccttgatttcttcatctataaaatggggataatcatacttattctgcaaaaattctttgaggattagatgaattgacagagcttgcctcacattgatacaaaaaagtgttcgtcacgagggagaaaaggttggaatgccataaactgaaatgaggcatgtaaaaaaggaaaggttatcaacattcaatctgaaggctgattttaagcacaggcttgcatagaaatccaaacagcacctatgcaaagtaagaggtatgctggtcagacttcaacatcttttgttaggtttttattatgtctgtttgatgttagaagagagttgctgacacctctcaattatccacaggtcagtatctagattttggccttgacttcttaccatttcttgttatactcttcttattctgcttgttgacatttgtacttctcttgctttagcacagcaaaagctagaagacaaactctattcaacttaaccagattaaaacttcctgtacccaaagcaggggttgagttggacaagtgatgtgtctgagctagacagaagacaatttcttgttttaccatcagtctgagtggtggtgccaatgatccctagcaagagtgggggaagcagggagaaaaggtgaggcatcaatgggccttcagctctttctgactggggtcctcgcagttggatctcattccttcatgtcaagtagaatgatgctcatcacatgagctgcatccatattcaaatgcttactatagaacagagttatgaataagaataatttggagttgcatgtgttacaacttcttcttaagttgcatgataaaacagatagttaacttcaagcaaactgctgcctggtatttgaaaataagtgcaagtgagtgacacacatgaggtcatatagtcatactacacagaaagaaatacactcttccaccttactgcctcactgagaacatgattgtaacttttttttttttgagacagagcctcactctgtcgccgaggctggagggcaatggcgcgatcttggctcactgcaacctccgcctcctgggttcgagtgattttcctacctcagcctcccgagtagctgggattacaggcatgcaccaccacgcccagctaatttttgtatttttagtagagacgaggtcttgccatgttggccaggctggtcttgaacccctgacctcaggagatccacctgccttagcctcccaaagtgccaggattacaggcgtgagctgccactcccagcgaagatcgtgattgtaattttatactgcctagtggatggacaacttctattggcagcgtcatgacagctaaatgtactgatggatggtacgtgatggtactgtgtagcttagttagaaaaaaagagtggaggggaaaaaaatctacaaggttttatgcctgtttatcagtctctcaaccttttataattttaagggactttaaatctaagacatgagtagctaaaaaatgatgaaagatgaaaactgaaaattaagagctatatattattaggttaatgtgagttagcacctctctggtaataataggacagtttgcttttagagactgagttgtgatatcaataattgttagtaccagtatttgacaacaaaattcatttggggagagggaggagcaggattccttgcttttagaaaaacacgatttaaacctcatgcaaatcaatttttgtgttattgtactgaattttcctatgatttccaaaggatcaccttatagacttagtcatatagattgtccatatattaagtctcattcgaatttgacaaacttttctaagtgaatgaaagttgattttccccaccactgagaaagaactatacccttccattttaactcagttaaaagtggggaggaaatattaaaaagtaaagaacagcttctgaattcaatttattctttttttcccattaagactaagttgaaaattggatatccaatttaccaccgagagggtattcaaatattcctgctcaatccctcattgcttctaaattcactcaaaggcaagattattaattcctcctgacagaaaatcaagatttaatgagcagctgacagcccttaggaattacgggagaaatttaatatgatagttttgactaaataatgtgcttttacatatatgagaaacatattatgcagaataatgaacatacagtaaatgttagtttagctgttaaatcttggacaagtgattaattttttaagaatatatatatatatatatatatatatattttttttttttcatcaaacttaaaaaagagccacttcttttccaacattgttacctatgcattttagcagatggccacaatatttcctcacattcatttttaattcaactaaacagttattttgcctcttattaactgcaaagtatgttaggagatagaacaaaatgatgtctctactttcaggtcttaaaatttggtggatggtggagacaagatacagagacaactctagcccaaagaggaattaaggtgcaatgggagataaacaaggagaaatagctttggatttgaggtagcagtgtgtgtattcaggagaaaagtcttcatgaagaaatctgtgtttgaaacgagccttgaagagtggctagggtgaaagtgatcaacaaagacatagaggtaggaaaggtaagatatagtcagagaaaagggcatcattcacttaggatggagtaaagggtagatgagaggagtaggggaaaatatacacagaaaagatctactggggcccagtgcggtggctcacacctgtaatcccagcactttgggaggctgaggctgtgtctttgctattctcacagctgccgggtacaccatgcttgtgtacatagtaggtctgtaataaaaactctgggaattgaataaattgtaaaattattttttcaatgcattaaaaaaagtttactttttcttaagccttcttaaacctctttaaaaatacgttaacttgcctttctaagatgaaaacatgaagagaatgttaacccaatgattcagacaacttatagagtgccacctgaaagaatgccactgctgaagctctggtagtctgtacagtctggtgacccttgaaccaaaactgttaaagtaacatcttgtggtacatgttataggaaaactgacttttagtaagtaaaaatgacctggcctaagttacttctgtataggcttttagctttcagacagcctccacagggaagtaatatcaagactaaaatcggtgtggaaaaatggagatgcagcaacactgtgtctgtgtactgagatgatttctggcctctcctctctttagaggaacactctacaacaaactaaaaagaggctgctaacaatccacttataagtttcattttgttgatggtaatgacaattgaatcactttggtttgagatactctatgtcatggttaacatatcacataaaataatatgcctttaagtatgtatattactgatttaatattgtactagctttcattttttggaaagaagatatgttttctatgcttggaatgcaatttaaataagccttaccagtcttccccttcccttccagctacaatttcatgtgctattatttgtatctctagtgaagtgctggggtgacaattgaaggagtttgacagggaagggcacttcttgtgcttttgatgaataagtataacatgaagcaatttcttttctatcaatggtcaataatgcacttaggaagaatgtttaacaattattataataaagcatcaaacgatctatttacatttaaggtttctgatagatctgagcgcgatagagaaatcatagtacttgtttattgaatgaatacaatgtaaatatttctcattattattaacttttaagagagtcaaaatatgtagagacattttaaaaattgttaaatagaggctgtaccgggagcactatacaatggtggacattaaaaatagttcctcctgggcaggcatggtggctcacgcctgtaattccagcactttgggaggttgaggtgggcggatcacttgaggtcaggagtttgagaccagcgtggccaacatagtgaaaccccatctctaccaaaaatataaaaaattagccgggtgtggtggtgcacacctgtaatcccagctattcgagaggctgaggcagaagaatcacttgaacctgggaggtggaggttgcagtgagtcaagatcgcatcactgcactccagcccagggtcgacagagtgagactctgtctcaaaaaaagaaaaaagaaaaaaaaattcttcctaagaatgcaccacatttgccatgattattttcatattcctgtaaattctgtgacattttaaatatggacacatactatgtgcaccttcttccatgtagaggtggaatccatttcattacccctttaacctgggctggccttgtgaactcctttgaccaacagaatgcagtacaagtaatgatgtgtgacttctgacctaggactcaagagactgtgtagtctccattcttgacttcttggaacattacatgcgccatgtaagaagcctgagctcccttctggagaagccatgaaatttgaaatgctgggctgacattgccaactaaccaccaaacatatgaatgggactaccctggaccaatgggctgcagttttgtgagtgacttcagatgagactagtggcaggaactgccaggctgaagccagcccagattgcagaatcgtgaacaatgattttaagccattaagttttgggtagtttgttctacaacaacagataatggaatatactttctgagaataataccatttattgagccccgcattctttctactcttgtcttgttggttctttgcacttttcatcttggtcttagcctatttattgagtatttcttgggtttagaaaacactcccttgtcgttttccccaccatatatcggttatgtttttgctactgagtttagcttatatgtttaagatcaatacaagcagagtcttgcattccaggatacgtaatgatataaccatcacccacaattctgtcagggaagtgaattggattgtctcccttggccatggtgtcactgataggtagaatgtgtgaaagggcaaaaagctaatccatcagctttgaacctaaaataccatcaagaaagatatgctgagaagtcctgtttcatcacacttaacaggtaatagtgaattaccttttctgagctggcactcaaataactgccttcgcttagagcaaaatcaggatatgggattaaatgatcaaacctatgttgatatttacttacacataatacaaataagatacccataatatacttgagttctccaaacaaatactttagtgtggaattctgggcctgtagcatccagaatgtagcatccagaatttaagcattcagaaatgcttaaactctcctataagcctccactagggtgttgtcccagggtcttacccatccctcaacttggagcctgaaaaacttactgaagactttctgactgggaggttgacataacttaccacacaactgttacaaattaataaggccatggaaacagctctaagatgcctatcaaactgcttaatctcatgcctatcggataatgcatttcaaatcagctctctgctgattcactaacgtcagttaggcctacacagtgcttccaagtaggcttatatgcaaaaactaccagaaaaactgatcattaactttcttctcaacatgttgtattaggagatttcagtatctttctctgcatgacttttttgcaaccctcatacaatttaccccccaaaaattttaaagcccaacatgatcctaattggtaatttaaattatacatttttatttctcctaggaggaaacagaaaaatgcttctttagaattatagaaggatgtttatctttgtttttgttaccatgtttcctgtccactctcttgtccagggcacataaaggaaaaaagattctagaaagtaatcagtgaagtcagactgccatggggtatgaacaggtgtaggctcaccctcacatgtgtgtgcacatatacactatgaacacaggaaaagagaacaatcactctgggtttgtcccccattcccagcccaagtatatcatggcatagaaatgaagatacatctgcatttccttggaatatggcagaaatggatagagagtcacaaaggacatattttggattgttataccttcctgttgagtacttcattaatctgtccccttttgcacaccatatgtgatatgcggcaatgttgactggaaagataacttgagaggatggaagtttgctttcctctgtgatatgaatttgctttcccttctcctagcttcagttatggtatcacagtacttctttgtgatctcataatgattcctctagtatctataaaactcatttcatcccaattttaaaagtgctaaatgcaaatgctgcagtgaacaagtgctgagtaccctagtaagtatctaagtggattgggacccttgctaaatgtaattaagtctcttctcttctacttaacccttgactctatttttctttaatttccttggcttccgaaacagaattctagtttgtcgcttaatattttggaggaaacgtcatgtttaattgggaagttaggttatccatgaggcatgggtgatttttattgtacttataagatagtttatttttcttatctccctgcttatgcttgctagcacttcctcagattttttctctctcctgagagctcaagagagacacatgtacatatgaacatactgccactagtaagctcaatgtagttgtataaacaattactttaaaagtcacagaattattgtaaatataacattttaactatctataactgatgattaacaaaggtacggaaggtcatgcatcttcatttctagaaaatatttccaacaaagctgccacattactgttttgcttctagtctatctttatagctcattattatttgtcaagcacttgcctgtacagtgttaacattctgcagcacctaccattttatacgtgattgatttgtatatttatttatatcttctaattggttgcataatgatcaattctctattaataagttggtgattttttctttgcgtttttaatttacaacatgacttttaaaacatgcaaaacaatgaaatatgatttaaaccactgtgaagctaactatgacttcacttaatctcagcaagttgctaattaccagaaaattctactgcaaagtttgcaaatcaattaaaaactattcaaatctggtttgcatgtttccacaaggataaatgatatagcatattttctcagctcctgcgaaggtgtctgttcccatttgacattcccaacttcctggaactcttctttgtttaattaaacacacatgagcacgtgcatgggggtgggaagggaaaccagacaaaggtaaacaaaacaatagaaaactgtgtccattcatctaagccttaaaaaaatgtaaaaaattttcactcagatcctatcagtgactcactactgtacatatatttctattctgtatcccaaattgagcaattttgggcaaatacttgctaatgtgaacagtgtactgagtatgacaaggatagaagacaagcattgtctttagggatctttcactgatagagcagatggataatcatgggccagtcacttaaattaatgcttctggaaagcaaaacactgtttatccagtggcatttctttgctcatttccttcacttgtaaattcagcataatcctaaataatctataatggggtaaacatgcaactcatgtcttaatggatgagtattatatccttataacatggtggggacagtatgtgaagtaagtataaatttgtgtatttttttgtggtttgttttcttatcttccatggtaccttccagtagaatagggtcttaagatagaattaattcagttacaagaaaataaagaaaattacatttcttatgcatcttagtttactgatttcagattcataccaattatatctatcaaaagactatgatttctaagctcttttaaaattaagtgccaaaattaaatgaatgaataaacaaaataacctgtcaaaagaagttatacatatctgtctacaccaagggagtcttaatgtgattgccaggtacctgtttgttcgtcttgtactattgctttaaaactaaattattctgcttttagaaaatgacataggctggtatctggcttaaacctaatgaaactcaagcgaattccaattttgaaccttcaatttcttctagaatttggcttttaaaaaccccaaaatatttgaaggtcggtatcaagaaaagagaggaaagactacattgttttatgtcagaattttgtcactccttttaccctttagagaaccttgggccttctgtggagacctctctgggagatctactctaatcataattgaaaatctgactgtatttttttcaagctgcaatgcctcactgccatttttatagttaaggcaccacagagagtgggatggactggaatcattctgaccactgacaaatattttgtgcattgaaagattttgtgggagggtaagctatatagaaagctatttaattcttttgatcgggttacaaaaccagttgtcttaatgcagtgagcaaggtgatgttgtttttttcttcttctttctaagtatatttaacatttaaaaatgaaagtggtctgtgggttgtaaatgaaaacaaaacgaaaaacaaaaactaaagacagactgattaaatatagttcaagttattctcagtagtattaagatacagaatcctagtggagtcttgaatctatgtatggggcaactttctttattcagtgttttagagatggatctacttagatagaaatcaaccacaaacgaaaagtcaatttagtttatcttcacttttgactttatttgagagggagtttctggctagcacagcatccttttcaatttgtttcagtataatgtgcagcagatacacttgattaatgaactgattagcaacttctttaattcttttccagtagttttttcattatcaaagctgcagtgaatccataaagttagtgttctttaactttagtaaaaactttataaacaaatttttttttcctaaaaaggattaacagaaaatattaaaaatgtttaatttcaaaataggtttctaagacctctcttacatataaatcctgtatctttcatttctctaaaagctgtaaatgcaagggatcacaaagctttcacaatataatagttaagattatactaagcaatatggagaaaattctagattttatttataattcagtaatctttaagccatattatgtatagaaatgatagaaataaaatattcaataatttagtacaaagataaaccaggctagatattggatttgacttctgttaatgacatattgctgcctaataaattatggcaaaatttaatggcttaaaacaataaatatgtattacctcacagtttctatatgtcaagaatttagtcttggctgggcgcggtggctcacacctgtaatcccagcactttgggaggccgaggcgggcagatcacgaggtcaggagatcgagaccatcctggctaacatggtgaaaccccgtctctactaaaaatacaaaaaattagctgggtgcggtggcgggcgcctgtagtcccagctactggggaggctgaggcaggagaatggcgtgaacccgggaggcggagcttgcagtgagccgagatcgcaccactgcactccagcctgggcaacagaacgagactgtctcaaaaaaaaaaaaaaaaaagaatttagtcttagcttaagtagtgtatctggcacaaggtctattatgaggttatagtcaagccactgatcaaggcttcgatttcaaataaggttcaaccagggcaagaccttcttctaagtccattcacatggctgctggcaaccaggttttcctggacatgtggcccactctataaactgcttaagtgtcctcacaacatggaagctcatgatctgtgagacagagagtgagcacagaagatggaagggaaccacattctttttataacctaatctcagaggggacatcccatcaatttctccttctattgttagaagccagtcactaggccaaccccaaactcaaagaacatgaataccaggaggcaggaatcattcggaactatcttagaggctgtttaccacacctaactaacctgttaaaattaagtgaacgtatctacttaaataaactcaagccttattatagcatcacttaagtggtttctgtctcttcccgtctatcatgattgcccaatagacattcaaatataagataggattttgaaattctaccactcaaaaacctctaatacagaatgatgttcaaactccccagtcatatatttggccttccaggatctgacttctcactctagttgcactgggctacttgtaaacattgcatgcttttccatctttatgccccctctatctgaaatacctccctatcctcctagcccatttttacctactgacgtttcctgcattcatttagggcccaattcaaatactttttctgcccttaatgcttctgagatgtccctagtaaaattcaatccttctctcctccatatgtccatataattcagttttacctctattgtgaaatatgaatatatagtgtaataaaaatatgtgaatatatatgtttgcttcctccaatgaactatatggtccttgaaaacagagattatggtttattcagcttattttcaacccttacagtacctagcacaataccgtgcttataattcagcagtaaagaaatgtattttagacttaattgcttgtgtacaatttcgtataatttttatataatccaggtctgtattgtatcccactcaatctgatgacatgctctttggtgacagagttttatgaggtttcagggtacatgattttcaatccaatatttaaacatacttgaaaaaagtgtaactgaactgttggatttatgggagaaaggtgtgaagccaaaatgctatagaaagaagaggtaagtgatccagtacagaaattctacaaacaggtatttctagcatggaatatttgaagacattggtaatttgatatactctgatacaaatatgaaattgttatgtgtattttaatatacttgtcatacctgtacaatagtctacttaaaaagagctagtcaaaatgttgaggataaatttcatgtagtaataatgtgttaagatcagaataatagaatttttaaaaaatttaaaagctgactcatatgatattttcattccaatgagccagaagtactagtgtggcttcatatggtcaatactatatctgagtgctttgatgacaagggctcttcatggaaaattccacattgagttttcaaggtgaaaaatggtcttaagttttcagtgagatttattttgtccttgtccataagatgctacatattataatagctgagcctgagttagcactgataagcttttaaaattatatttccttatgatatacttacctgcatcttcctctaattcctcatttagtaaacttcttgaaattcttagaatcctttgatattaaaagtgttccctttgtgtggtatccctatgaagtataaagcaattgtatcatttacatagcactttccctaaggatgtgtaaaaggttggaatgaagactctattctctgttgtttgtataaattgtgttcaccaatgttaccatgtactgggaccatagtcttttaatcacttcctattcttattctctataacatatagtacttgaaacaataatcagtatatatttgtatactttgttatttaaaaaatataaagctagatgatagtgaccttgggcatgatctattctttaccaagtatttaaaaaccccatttggccgagtgcagtggctcacgcctgtaatcccagcactttgggaggcggaggcaggtggatcacttgaggtcaggagttcgaccagcctggccaacatggtgaaaccccgtctctactaaaaatataaaaatcagctgggtgtggtggcgcgtgcctgcaatcccatctatttgagaggctgaggcaggagaatcgcttgaacccaggaggctgaggttgcagtgagccgagatcatgccactgcactccaacctgggcgatagagtgagactctgtctcaaaaaaataaataaatacaattagaaaaaaaacattttatggtatactttcagggactttctgattttaagaatccaacatcactgttcatataacatttaactttcccaatacacatatcttttaaaataaaattttattttagaataattttaggtttaaagaaacattgcagagatagtataagagtgctcataaactctgtacccactttcccctgttgtaaatatcttatactagtgtgctacatttgtcaaacaaataaaccaacattgataagtcatcattaactgaagtccatactttatgcaaatttccttagtttttacatactatcctttttctgtttcgggatctcagccagtatacagcatcacatgtagctatcacatctctttgggctcctctagattgtgacagcttcttaaactttccttgtttctgatgaccttgatacttttgagcagtaatggtcaagtattttgtagaatgtccctcaatttgggtttgtctgacaatttccgcataattagactggggttatatgttctcggggaagacagaggcaaaatgccattctcattgcatgaagagaacatattatctacctgtcttatcactatctctaatgatgttgatcttgatcacctggctgaggtagccaattgacctacttttcatcatttttgtttatccaaaaggcattagagacttaatgaagtaactagaaaatagtcacataagctatttaacctatttcaccttacatatgtatatactaagtagtcaggattcatgaggatgttaaaatttttctttcattgtaacactacaataagctatttatggagaatgttaagtagaaaagattaaaattttaaaattaagaaataaaattagggttattacactgaatagaagttgccttttgtgcagttcactaaatatataaaatactgatttgcagaacttacataaggatttttatagtataatatttatatgtatataataaattttaatctttttcaatgtgataactgaaaactctcatcttcaattcttgaacatgaccaagatatttagtaaataaatgatacacataatttataagaatgggggtgaatgaaaaccatgtagaaaaatttaagtaatcctagccacaaggatttaggcaatgtggaaaggcaaaagaataaaaatatataaattaaatagaacatgactaaatgaatgaggtgataatttgttaaagagatggaaaagcaaaggctgaaaagttttaaagtaaacaaattccagaaaactaaagtagttaaaaaactatagaattcttccatttaagtcaataaaaatgctttttttttaagcaacactgaaattttgtatatgtatacccagagtacaacttgttgcagagcatatatactgactgtgaacataagtattgattctagagcaaaaatcatttgcttttaatttctgctcattttggttgagttagaatgagtaaactactcagaggatacagatcactacgattccatagagagcaatttcctttattagaacattgtcaaaggaaatcaacggtattcttcagaaaattaccagagtaaattattgtttttcttctcattccaaaagaaattaatacaagatgacatgcaactgttgtggtaaagattggttcaggaatgaatcatcaatagtagttaaggctagagggggagtttgatgtagagcaatatatttacatggtcgtaaagtgtctttccacagattgcttattagttgaaacagagaaaataatacctataaaatgaaggtatcaggcaacacattgaccagatgatcgaagttaacattaccagtgagggacagagagacattttgtgcctccagatgtgaaccataaggacatactttgcttatctagtagttaggacagaagtacataacctgaatctaatcatgaggtaaatacaaattgaggaatcttctataaaataactgaccagttttcttcatatttaacagtgtatgcaatggtatgaggaactgttccacattaaaggagactaagaagacataacaactcgatgcaatgtgtgattctggactggatcttgcattggaggagaaaatgctataaaaggtatcactgagacagttaacatcattggaacatggatggttgattagatggaagtattacattaatgatacatttcctgaatttggtaactttgctattgttacctacaagaataatcttgctcttaggaaacagtaattgaagtattaaaaatttaagaggcataacaaaatgaatgtggctaaatgtttaaaatggtgaatctgcacaaagggtatacagggatttccaagtactattcttgcaacttttatgttcaaaattcaaaaatattcaaaatattcataattattgcaaaatgtaaaaaaaaaaatagaaataaagatgagttttgggaacccaattcagataccttatccactaagattaaatttgactaattacagattaaacagagcgggcaaaaccaaattttttgacatcaatttccagtctctgggattgcccactctagtgtcagtcaactgccatgtcctcagacagtctatacagagacttcccctgctgacgaggaggaactaatatcttaatatgggttttattttatgttaagtaaggagaaggaatatttaccagtttaagattgtttccatattatgctagtgacttttacttcagttataatgaattgagacatttcttcaaacaggatcacaagataaaaatagtgcagagttaaagctgcctctacttttggactttggatttacttttttgcatttcgttagcctatttcaaactctttcccattcttaatagttgcttgctggcaaagccgcttcctttgtttcacataggctgcttacctagccagtgctggggagaagcctccttctggggatgacactgggccacaattcaagatagaatcagatttagtgacacttaagatttggcctagactagaatacaaaatgaaaagtagaagttttacagctcaccaaactgcctctgcattcactcagaaaaaaatgttccaaagcgttcaagctagcttttcagaaatattatagttgtaaaatctgtgacaccagtaatagttgtgccaagcacgagttttattttagtaagttgtttacctatgccaatatttaagtgtacttctgtgcaaaaagatgtggataatagttctctttatagaaaaatcaatgtacccaaatagtcgtaaaatatcacagtgtgtacatgcacatgcattatgcaagtacaaatagatctacattgtgccagatgtgatctaatcatcgtggaagctctgtttaggtatatgatattaaaaaatgctgaacaggcttttttctcagagtgaagccacacattccacgttactaatagcaaattatatttgacatgtaattttaaaatgaagttactctaatctaaagtaatagtgcaacaacagggataagcaatgaagcctttcataagacaaaatggattttaagattctagagagtttcagttacaagtaattagaaatgaaatttaggacacgtaaaatgtatttctttcaatggttaattacatttggccatctattgttccaaatggtgatggactaataaattgtaatcatcatctctctacatatcgaattgtaatgttctcataagcagtctatacaactagagaaacctatttctttcaatcctaaaaatttacttcagtaaaacactgagttgttacatacatggatgcacacagatatgtgcacataacagataaacattagtatgtatataagcatatatacatttaattttggtcttgtaaaacagaatgggcctctaaaaggcattttaactgtgatgtatgctatgtctgtaaaaattaagttagttagccgattttactggaatacatattctaaatatctcagatttatgatggcatgctttgagtctaacgaggtctctcaatatacaagctctctctcctcaatctacaaatgttatttctatttcttctattagaaaacaaagaaaggaagaaaaggaaagaagaataaagaaaaataatgtaaaatagtagtggaaaaggaagtaaaaatggaaaacgactggaagaaggaaggggaagggagaggaaggaatgggaaagggggaagacggaaggagaacaatacaacctatctctattatttctaatcaagtcgatgagtgtttctagagaaaattaaagagtcgtatataatagatttatgacactacaaattaatggaccaaaattttaagcccatcatacctttcatgtttccatagtcaccttccctactcacctcaaatctgaccttatcaccatcatggcctctttacccaccactccactgaacctgcactcaccaacgatctacctatgaaacccaaaggacttcttagtacctgtgctccttgttactatatccaaaggacctcactgtagtataagtcagtatcagctactctttccttattgaaacagttttcactaattgtcactgtcctcctacctctttattattttttaatggattccagttccttggagagattctcaatactgtcatctattttctcaaacttattaatcatagtaatttaaaaaatcatgctaatttaaaagtctatgagaatgtcaacagctgactcattggtaggtctatttctattgtctgatttttcccttggttcagtttcttcataagccaattaatgcatgattaaatatagacattttgtttgcagaaatcttggagccactagatgatattttcctccagagagggttctctctatcatttataggcagctggagtagaggtagatcaccttaatctaatcaaggaatcaacgaacaaataggtgaagttgcagtctttcaaaagttcagtctatatttagttcataccaattcctaaagggtaggttctttaagagtcccaaatgaaatgctggggtgtttcttggggctgctcctctgtggagggccctgaacattattttctatttcttttatactatgagtgggaaagctccactctgcttttcagtcacttactgcttgacgggttaggctttttcatcccatgaacagcttaaggatttggcaaatgcctggaggttaaaactactgagtgcaagttcatttctctactcatccactctcttcaggattttggcccccttcagtactgactgccttgacagccctcaatgttttcctctctctctaagcctataagatagctggaacttctggtgacttctctgtatcatgctgtaagaattggcaaatgccccaaaaggaaatatgcctcatttctctgtagttttccttgcttgagattttaacttctcaagccctggctgtcttggctactttccaatgccttcaaacagactttttgtctgttatctggcttatgtagatattcttggcagagcattgttctgccacaagttactatacaattttcagaagtagaaatctctctttggctatttttttttcccagtactctctctaggcttcttgttgtatgattgaatcttaaacattatttcttctttcaggaatatttgcctcttgcctaacttctgttttcctgtttcactctgacacatctttctatatcagtttagaatgctctaggatgtgtgctaattctgaaagtcagatttaggtgatttttctatatatgcccttaatacccaacagtacctccacattagcacttaacataattcattataattccttatctacttatctgtaccgtccccttatctgtaaaacatatgagggcagatgtaatatcatgtgtactactgtattccaagtactttgccactgcatctctaagcacttagcacattgcctagaacacagcacagtaaaaaattgttgaataattgttggttcatcagctggtaaacagcaaagagaattaactatgtggctctatatctgtcttcttctacctcctctattcttcctctttagagtaatcatactcttttgtcccccactgacagctcaattaatgtgatcttgggaaatctatcacacctatataacttgaataaagccaagttgcctcatagttccctaccagtacagagtcatatccaagtaaaaatgaatgtgaatacaaaacatgactgaaaaacaatataagtagttaccaaatcctttccaaggatatcaaaggaggattccatttataatgtgcaacagaactaaaatctttttttttttttgatacagtgtcttgctctttcacccaggctggagtgcagtggcgccatctcagctcactgcaacctccgcctcccggattcaagcgattatcctgcctcagtctcctgagtagctgagattacagacacgtgccaccatgtccagcatatatatatatatttttgtagagatggggtttcaccatgttggccaagctggtctcctgaccttgtgatctgcccaccttggcctttttttctctatgtttctctgactcaacctttgacacttagaaggtagcacacttccaacatatccttccgtcttccaagatatagtccatacaactttccatagttcgaatgtttatcccccaaacctcatgttgaaatttgatccccaatgttggaagtggggcccgatgggaggaatttgggtcatggaggtggatccctcatgaatgacttgatgtcctccttgtggtaatgagtgagttcttgctccattagttcctgagaaagctggttgtttaaaaacaaaaacaaaaacctgtaagctcccttccctctctctttcttgtcatttggtctctgcacatgccagctccccttctccttctgccataaatggaattaacctaaagccctcaccagaagcagacgctggcactgtgcttcctgtgcagtctgcagaaccgtaaaccaaataaatctcctttcgttataaattacccagcctcaggtattcctttatagcaacactaaacagattaagacacaactgaagacaaaaaaacaaataacaacaacaaaagcaaataaataactctcttcctacctcagctcatgcaagctttgcggtttacatatcatctccttatagtgtggctcaacttagcctctttaacttattgcaacttttatctctatttaggacatttatataggatggcctaagaactaagcaagaaagaactccttttcctttggttgctggtgcttgtggaatgcttgtggtgctaaagtataaagttgtttttttaatcctcatatttgcatataagccccctcttctcaaaattttcctctggcaccatatcctcttcctttatcctcttcccttgttttattttcatcactagtcaaaaactgaccagaatcatagcacaacagttgtactacaaaacacttagaaccacaaaaagggaagtaaaagttcacaagttttaaaatcagttagacttgataaagaacacgtgtcatttgaagtcttcaaaaatgctcatgagccctattttgagatttcacacagtctccatctactttttcatcctcttataattaaacctgtttttcctcaagcaccaccattgaagcccaaaatataaaatgatcttattcaacgttattgcttttgtttaattagtagtatatgataaatgtgttcactactgtttcactgcaaatgtatagtatttcagtaacattattggctatcctaggggagcccaaccaccatttataacactgccttggtaggaaaatgctttctggattccaaacaactgacatctaaagcaaagttttcccacttgggtaatcaggattcaaacaataatatgccctacatctgtctacagccatttgtaagatagggactgcctgtatttgaaaaacacacgctgatatgttgcttttaatcagggaaaaaaatgtttggatgatgaagttccatgcctagatttctcttcctagttttcaattacattcctccattctatcagattagactcatgtaaatcctaaagaaaattctgtcagtacaatatatgctctacttttaatcttaaaaataattttcatgtacgacccagttaagtatttgggttacagaaacctctcaataactacagtaatcacagtttttcagaaccaagtagatgtattaggacagatgttttgttttcaaaattctaactaatgaatttagaatttttctttcgcttgcagtgggcctgatcaacatgctactattatatgtcgttgcctaccagcattaattagtccgggaacagtagaggagaaaatggacaatggttatttgcagggttggggctaggagcagctgagaattgggtagagaatgaatgaggagtgcttttgagtacgtactgacatgttggacagcagagtcatagttgggtagggacagaaatgagatagatggaaaagttgaatgggaaaaaggcttgtagaataccaaacggaaaagcagaagcagagtgggtgtggactaggaaaggtggaaggaagtggacatgttcaaataagagaattttagagtacttggaggtacaacagtttcaagagataatgaaatctaaattggtaaccaatggttctagggaatcaatgagaagcttgagtcaaagttgactcagagtttgaacttaggtgactgggcttattactgttagagatggagaaggtagaaggagtaacacactttggaggcaagacatacttagcactatgctggaatggatactaaaaatagtacagtattcaatgtctattcttaccttttgttaccaagtgctaaatggatttggtgacttttttttttttttttggcattccttctcatatggcctgaccacaatttcttttttctattcccatggattcaacaagaagagatactattttaagacttcaagagcagtggcatttttgcccttcagtttggcaggtcactttaggataaccattcgaagcaacctcatgttcggtgtcacaatcttctgtatagagcaatctttgcatgcctgtttcaaagacatttgtggaggctatgatctgctcaggggaagaaaagctttctcagagaaaaccacacactcctgcttgaggtcatttttgttaggaaacacgtctgacaagactccactgatactaactaaacctgccattccagggtaaagttgtctaaagatgatgatgaacttctctggatagtcaaaattgtgaagtggttgccagaggcctggtttgctgacattgatcaaggtcaaatttatgtactcaaagtaggaaataagaaacacttttcatttattgcagtcatgcaaattaagttcacactcaagcggcatatgacaaataagccacaggcaaaaagagtttctatcaaaatattcaacatatagttcagagcatgagcagtttatctagccccagatgctccctgtgtcatcagtatcaaaaaggcaaagtcagataaaactgtactggaatatgagactacatgtgggctggtatattactgcccttttgtgtttttatttctcctaataaattataaggttgatatctaaagtaaaagaatattgtattctttgatatacttatactgtacctcaaggctaccctttgtttgctgtttgttcttttgttcattcatctactcatttattcaaaaatgtctgaagggcctattaagttcccaatgacatgcttaatgccggatctacaaagataaataagacatgctcccaatgagctcactatctaataggaaagacaggcaggtaaagaaacaaagacaaagcagtgtgggaattcagtgggaacaacatgctgaaagcaccatgcaagaactgagaaagtatattcatagccccccggtgatggggccgaattgagttttaaaaggatgagcaggagttcatccaatgaaaagaacaagggagggcagtccaggcagggggacacagtgggcaaaattataaaagaatgcagggatttgaagggggacaagactggaagctggaatgccatttagaagattgctgcagttgtctcagcaacagttggtaaaacatgggaataggacaatggtagttaggaagccacagaggtgacacattcaagaaatatttaggaaggaaaacgggcaggatacagagattgtgagatgtggagatttatagagaaggaagaatcaaggttcacacccagttccctgctagagtgagtagctggatggtggtgccgcctacaaagaatcaaaaacggaatagattttagaagaaaaagcagagttaagattttgacatgaactgaaggtgcctattgaacatctaggtagaattgtccagcaggcatttcattatgcaagccttaagttccaggaagaactgtaggctatagctacggagttagaaatgatttgcatatagacagttaaaaatatgagagtgggtgaaatcacacagaaagattcttgtgtagagtgtgagggttgaaccttggtgaacaaaagcatttaatgtacaaggagaaaaagaaacatcaatgatgaggatgaatcaaaaggtatcagaaaaatcaggaaacgtatgttgttgtcacaaaaacaacaataaatttcaactttgtagagaaatccacaactatggagatgacagattctgaattttttctagggttgtgttctagtagagttacagtaaaggtgcaatatcttatctatgcctctatttctgggcaagtaagtgtctgactcattgtaagttttcaacaaatatttactgaatgaatgtatgtcaatgtgaagaatatatgttgttaagtaaaatataaaggcacatggacatggaaagcacttaagtcatttttactatggtacctggggtactatcttgttggtaataaaatgccaaatgaagataatggtaacgatccagtctggaggatgatttctccggcatagaatattcatcacagcacttgaaatgggcaagccagatagctcatgcaggctaatcactaatacaacaaatattgagcaactactataaatatttgccaaacactgttctaggcactggagagtctttgggtaactagaggagttaaagcatcttctctcatggaggttacatttcagtggggagcagaagacaaatgatgaacaaataaatacatgacgggtggtgataaatgctcagaaaacaaagtatggtaaggagcaaagaggagggtactattctacggtttactctaaaatctagttaattcttgccacccacatctgaaatgctgatttttactgtactagctttctttttcttaaaagaaatctaattctacagtgaataaaaattactcatgatttcaaaaatatctagttaattcttatttctgatatgaaattttataaaacacagcagggaaaatgaaatgaggagccaaataatttggggaaaattatattatcaatagcttacaacagttttaagtagcttagaaaacagaaatgaaatagatcataaaaaaattacaaaatggaaaccacagctgctatctatttcaagtactatttttaatgagcaaatctggttttgaaactatcgtaaatttacttgaatgatttctcccccagctcttttccctttttcatttttcaaatattgcccaaaagaggtggtgggtaagagggattatgttatcacacagcttccacaaagtgaaccctggtagtcgtggaagcagaggaaataatttcccttggcatacggtattattaacagtactggcatcctttggctgattggaattccaaaggacaaagataaccacttaaataaaataggattatgaattggaattgataagaatgagatgttcagtccatttaatcgtggtcattatctccatatctgaggttagttagaattctttcaaatcatttctatatatattaggaaaaggaagtactctagataggagttagggacaaaggaatcccccatgagtctatctgcttctatctggtctcaaaaatactgggagggagggaggtatggagatgcaaaaggacaaaagagaggaaaacattccaattttccaccaatttgatttaaaaattcaccaggcaataagaacaaaagtctcgtaagaaaaggcaccctctttgcctctaggctgaaatgaattgtcattgttcatgaaagccctgtgagacagaggtttgactcagctagctccccttcttctgggatctccaaaggcatgaaaggaaatagcaacaccttggataataaagtaggcaagccccacctgaatctgtcatgtaaagtgttaaaagtcttgcattatttgcttgtgattaccagctccattttcttgtgcccttagttcaggactgccgctgcttaacagacagaccactagggaggtctgtgaacaaacagtatcttatttctccaaatagggaaagaagtgttcatgggcaggaggtaaataaatatactgtttgcagtaatgcaatgatagttctccttctccaagcaaaaataagaacaaacaaaatattaataatgaccataaggacaaaaaaaaatgagggttccatttgcctaaaaggcatagtataactcaattttatcagtaaaatgcagttcctagttttgcctctctgaaatacagaattcaactaattaaagcactaatgaaagcagtcatgattttaaccagataaacctcaaattatgaacctcatagttcagaagtatttcttgactgaatgcatcaacaactcattaatctgccagacactttcactatgaaacttgaaagtctgggccagatgtgtggtggctcacgcttataatcccagcactgtgggaggaccaggcaggcagactgcttgagtccagaagtttgagaccaggctgggcaacatagcgagaccccatctcttaaaaaaataaacaaactgatagtctacatactaatcaaggatgtaagttctgtatagagagtaacaagatcacacgaggcttgggtttatcacatacaggaatagaagcacagtttgaatgtatatataatccagcaaatctatattatggtatagtagaaaaagtactagaggacgtaagttctgtcatcaacttttctactaactaggtataagaacctatataagtccttaatgtttatgtaaaaggaaggagttagcgaatgttctttaacctcattttcacctttaaaattctatgattctaggacctatgtgcaaatgacttctattggcagatagttactaatcacaaacttctataaagtctgtttggtaagagttctagggataacattttctgtacatttgaaataatttataatttgaaaagagaaagatgcacaaagttggtgttcaataaatgtttacaagaagaattaagatttgtattagtccattcctatgctgctttgaagaaatacccaagactgggtaatttataaagaaaagaggtttaattgattcacagttccccaaggctggggaggcctcaggagacttacaattgtggctaaggcacctcttcaaagggcagcaggagagagaatgagaacagagccaagggggaagcctcttataaaaccatcagatctcctgagaacatactatcctgagaatagcatggaggaaaccaccgccatgattcaattacctcccactgggtccctcccaccacacatggagattatgggaactacaaatcaagatgagatgtgggcagccaaaccatatcaagattttatacctccttagaagtaaatgaaaatcttcctgtcccagaactattgttgggggtgaggaaaggcaaggaatgtgtatgtaaggaaaggggagtaaggagtgggaagaggactcattccagaatatacatcattttgtacaatgtgttgcaaattgtattccataaatgcaattgtctagttcatttggaatgctataacaaaataccatagactgggtaacttgtaaacaacggaaatttatttctcacagttctggcagctgggacgtctaataatatcatggtgccagcagtgtctggtgagggactgcttcctcatagactgcaccttctcactgtgccctcacatggtggaaggggcaaacaagctccctcaggcctcttctgtaagggcactaattccattcatgagggcagagccttcatgacctaatcaactcccaaaggccccaccttctaatacaatcacaatggagggtagacttcaacatacaaattctggggagacacatttagaccaaaacagcaatatttaattgtgtttcataaatgaacacaaaggcagtatgaaagtggttcgttgatgaaacaagtgatcatgaagaacgttcttggatcatctctaaaactattaccaaagacaatgttgtacttcgtcttccattttaaactgtctgtgtttcgtcagataataagaattataaaacataacatgttttcttttctgtattggcttccagtaagctcagagctaaatttaatgctcaataatagtaactagccttaatttacatatttggaataattgtgtaaaagtttccctctaacttttaatttaactttaatgggcctttgttgcaaaaaccacctgaaatctttctgggaagtagatgaaggatagattaggatgtaatcaacatgtatctgtgttctatctaaatagagaaggaaaacatttatgtaagtggaaattagaagatattttaaaatcatgatatgaaaaaatcattagaaataaatcatctttgagtaattatttccacaaaagcactgttattgtgtgggagaagttataactactaactagatgtggaacacaaaaagcaatatagaatgtaaaattcagtgccttcagccatcattgagactacacagcaacaggaaatttaaagaaaaatatgataaaacatttttgaaaatgcaacatttggaaacgctttgaagttgcacaattttaacagttcttttaaaaaaacatagcctgtacatacatcaaaaatcttttttatttcaattggaaaagatgaagaagaaaagaaggtctaagaatagcaaagattaaagtaaaatgaaataacattcttgttatccagatttggtaggtgaatttttttattcacttttagaatggaacattgggaaaaagcaggggggtagggaatgaatgtatggaaagaacaaaaacagtttaaggggccagacgctgtggctcacgcctgtaatcccagcactttgggaggccgaggcgggtggatcatgaggtcaggagttcaagaccagcctggccaagatggtgaaaacccgtctctactaaaagtacaaaaattacagcgcgcctgtaatgccagctactcgggaggctgaggcaggagaatcgcttgaccctggggggaggaggtgagccgagatcgcgccactgcactccagcctgggtgacagagtgagactccatctcaaaaaaaataaaaataaaaaataaaaataaataaaaaataacagtttaagagactacagaaaaataacaaataagctatttgacaaagactgacagatggatatctgggccaccactgaaacagtaacctctgttgaaaattacaggcattcttatcaatcagagtcacaagtatacttcatcttcttaggtatactgagggctatgcatggactactattcctttaaacacttaaaaaccattttaaagacatctaagcatttttaaagaaaagagagaactggtgaatatgacacgtggtaataactgtcttttagcctatttttgtagatccaggtgacttacaatatgaggaaaataataatttgaggaaaataacccataaatgtgaattttttttgaaacagatgttttcaatgcaacggaggacatgactaacaatacaatgaatctcttttaaaagtaagagatctctgaggggaaaaaaatcaccttcatttatcaatcttgtaaaatattattttcatttattgggttgtttaaataggggcatatctgaataccactgtgagcaaaaacgaagcaacctggtcaagcttgggcacctgaaattgcagtcatcaaaatacactattcagaatgttcaattactttttacaggtatcaaacaatgtatagccaactctcaattatacaggctgttagagagaaagggtggtttggctaatttaaaacagcaaacaatccagaaattctttatgtagatttggaaaaccattttaaatccaaaattgcctttgagatatgagtcaccatccaggaacattagaaactgagctggaatcgggaatcctgagggcagattaaagtcttctcatggattgtcaaggctttattattcttgtttctagaattgggggagctagaaggtatgcagctattatcctcagctacagagaaaagattaagaataggaagggccctggaggaatttcttggaaaatcccatattttctcattgaggagtttccctgctcattcaaggactaaagctatactcacttgcgctctaatacacagaatctaatccatagagaagttcatggcttgagaagctttctagattaaatagacactactgagagaaaactagatggaaaaaactatatatatatatacacacatatatatatacacacacaaacatatatatacacacacatatatatatatacacacatacacacacatacatacatatatatatgctattagaaggacatttttaaaaattttggaacatgtttttcagtagggattaataaaatgtcaagctcttctggggattcttccccatcctgatttttcaacataatcctacgctattactttatctcctctagttttacagctacgtgtaaatgaagctgctgattttggatctatatgagaaatataaaaatcaagaactcactgtttatgtaagtttatctcatactgccagctctgcttaccaaaaataagaaagaacagaacaaaataaaatggcctactaggcacttaaaatccatgccatgttccatggcagtgagcaggacttctcatccatttaaagtttgagaagagcttgatagtattctggccccaagccttctgctcatttgatttgccatacaagattgcattcccagtgccaagggcagcaggaattggcccaacgctacagtgctattcattttcagagccacctgattttgcaggtgagtagttatatctccacagagttctacttctatgactaacatcttgctcatcctgtaacagacacctattctggggtctgatgaacatcagcattgggaggtttaactcagcgtttggctttgtataacatgattttgctggttctgacatcagccatatgtccaactttggaaaaattgcatttttgcctgtagggtttcctttaaaaaaagcagggctagaggaatgtgaagatgatgtttgtaaatagattttttaaaatcataaaagctattggtttctcagaaactctaagaatatgtgtgactaaagccttagctggtcaatgttttaagcttctcaggtgagatcaataggcttaaatttttattagtaatacaagttaataacaatttattaaaatgctattgtatttcaccacaaattccttgcatatatttttttaaaagctgggaaaaactatcatcactttatctagaaagatgacttttttccctccctttaggttctgtcaatgattctcagccttacaggtgagagtgacataaattatagattattgccatgctttgtgaaagttgtgagaggcatagtttgaagcgctcatctttattatttcattgataagaaaaatacagaaatcgagataggctgttgaggtctgtaaataattttttttcttaaaccatcacctgtataaaaatgacaacagaattagacttgctgtctgaccacaatgaataaataaaattatccagttcaaatgctctgtaatgatttcttccatgttactgtgaactaccatagtgatatgtgtttgaatggggactctggtagaagcagtgttgaagcaatgcaaaaattaactcgaaaaaaacctgtgaggtccatcactatggactccatcactatgtgaggtgacaggttaattagcttgattgtagaaatcattccacaatgtatatgcatataaaaatatcatgctgtacaccttgaatatacataatttgccaattatacctcgataaagataaaacaaagacatgggattgcttctaattctgcattattatgaatgagtaaaaaagaagataaaagaaaaaaacaggccagatacagtggcgcatgcctgtagtcccagctactcaggaggctgaggcaggaggatcacttgagccaaggttgcagtgaaccatgactgcaccactgccctccagcctggacaacagagcaagaccttatcctgaaaaacagaaacaaaaccaaaaaccaactagtaagaaattcagggggaaatagccacaggtataatcagacaattatctgaaaagagatgacacaatatctgtaggataaacaagctgcgttgcctcctctgtgaagactttttggagtatcacaaactatagtgatcttgtccttctctgaggtcctattgccacagagcctattttttgcactaaaaatgtaaacatgtgatgtgataatgaattttgattattttgaaaattctaggatatatgaaacctatagaacatcattttggtacatatttgtttttgcatataattcttttattttttataagtcttgattacccaagtaaacagagcaagctttctacatttatatttcccacagtactaagcacatagtatttcttcagtaaatacctattgatggagtacattcatggccttatggctttttttttatttattattttttttgagatggtgtctcgctctgtcgctgaggctggaatgcagtggcgcgatctcggctcactgcaacctccaccttccgggttccagcgattctcctgcctcagcctcttgagtagctgggactacagtaggcgtgtgccaccacacccagctaatttttgtatttttagtagagatggggtttcaccatactggccaggctgatctcgaactcctgacctcatgatccgcccgcctccgcctcccggtgtgctaggattacaggcatgagccacggtgcccggccttatggcttattttatatgtttattattatgagtataatccttcagatgtagaattcactaatctaccagcttttcagagtgagaagtcccttgttttgctactgatggggttcaagacccgctaccaacagtatgtcaccttggcatttgataaaatagcagaagcaaggtcactctcaccttccccttgcccttctctcttgaagcaggccataaaaccttcattccagaggtacccccaaaccccacattcagaggaaaggaacatccttatctctgaagatacaaggacacagaaaagaatcagaaaacacaggccttgttaagtcccccacactttattattattagatcatatcccctttgtccagtcatatttctccactaccctccacttcttcatcaaacctaagcataagaatacacaggtttgggttcctgagccaagatggctgaataggaacagctctggtctacagctcccagcgtgagcgacgcagaagacaggtgatttctgcatttccatctgaggtaccgggttcatctcactagggagtgccagacagtgggcgcaggacagtgggtgcgcgcaccgtgcgcaagccgaagcagggcgaggcattgcctcactcaggaagcgcaaggggtcagggagttccctttcctggtcaaagaaaggggtgacggacggcacctggaaaatcggatcactcccacccgaatactgcgcttttccgacgggcttaaaaaacggtgcaccacgagattatatcccgcacctggctcggagggtcctacgcccacggaatctcgctgattgctagcacagcagtctgagatcaaactgcaaggcagcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccaacatgcagctggagatctgagaacgggcaggctgcctcctcaagtgggtccctgacctctgacccccgagcagcctaactgggaggcaccctccagcaggggcacactgacaccacacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaatcagagcgcctctcctcctccaaaggaacgcagctcctcaccagcaacggaacaaagctggacggagaatgactttgacaagctgagagaagaaggcttcagacgatcaaattactctgagctacgggaggatattcaaaccaaaggcaaagaagttgaaaactttgaaaaaaatttagaagaatgtataactagaaaaaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaaggaaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagaacgccacaaagattctcctagagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccatacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgctaaaatgtaaagaccatcgagactaggaagaaactgcatcaactaacgagcaaaataaccagctaacatcataatgagaggatcaaattcacacataacactattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaacaaaaggcaggggttgcaatcctagtctctgataaaacagactttaaaccaacaaagatcaaaagagacaaagaaggccattacataatggtaaagggatcaattcaataagaagagctaactatcctaaatatatatgcacccaatacaggagcacccagattcataaagcaagtcctgagtgacctacaaagagacttagaatcccacacattaataatgggagactttaacaccccactgtcaacattagacagatcaacgagacagaaagtcaacaaggatacccaggaattgaactcagctctgcaccaagcagacctaatagacatctacagaactgtccaccccaaatcaacagaatatacatttttttcagcaccacaccacacctattccaaaattgaccacatacttggaagtaaagccctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacatcataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaacccttcaaaaaattaatgaatccaggagctggttttttaaaaggatcaacaaaattgatagaccactagcaagactaataaagaagaaaagagagaagaatcaaatagacgcaataaaaaatgataaaggggatatcaccaccgatcccacagaaatacaaactaccatcagagaatactacaaacacctctacgcaaataaactagaaaatcttgaagaaatggataaattccttgacatatacaccctcccaagactaaaccaggaagaagttgaatctctgagtagaccaataagagtctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactgattttatgaggccagcatcgtcctgataccaaagcctggcagagacacaaccaaaaaagagaattttagaccaaaatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagtcaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactaaatgggcaaaaactggaagcattccctttgaaaactggcacaagacagggatgccctctctcaccactcctattcaacatagtcttggaagttctggccagggcaattaggcaggagaaggaaataaagggtattcaattaggaaaagaggaagtcaagttgtccctgtttgcagatgacatgattgtatatctagaaaaccccattgtctcagcacaaaatctcctcaagctgataaacaacttcagcagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaataccgtgaaaatggccatacttcccaaggtaatttatagattcaatgccatccccatcaagctaccaatgactttcttcacagaattggaaaaaactactttaaagttcatatggaaccaaaaaagagcccacattgccaagacaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactgcatcccttccttacaccttaaacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaaccaccttcagagtgaacaggcaacctacagaatgggagaaaattttcgcaatctactcatctgacaaagggctaatatccagaatctacaatgaactcaaacaaatttacaagaaaaaaacaaacaacaccatcaaaaagtgggcaaaggatatgaacagacacttctcaaaagaagacatttatgcagccaaaagacacatgaaaaaatgctcatcatcactggccatcagagaaatgcaaatcaaaaccataatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgatccagccaacccattactgggtatatacccaaaggactataaatcatgctgctataaagacacatgcacacgtatgtttattgcggcactattcacaatagcaaagacttggaaccaacccaaatgtctaacaatgatagactggattaagaaaatgtggcacatatacaccatggaatactatgcagccataaaaaatgatgagttcatgtcctttttagggacatggatgaaattggaaataatcattctcagtaaactatcgtaaggacaaaaaaccaaacaccacatgttctcactcatagatgggaattgaacaacgagaacacatggacacaggaaggggaacatcacactctggggactgttgtggggtggggggagtggggagggatagcattaggagatacacctaatgctaaatgacgagttaatgggtgcagcacaccagcatggcacatgtatacatatgtaactaacctgcacaatgtgcacatgtaccctaaaacttaaagtataataataataaaagttcctaatagtaaaaaaaaaaaaaaaaaaaaaaaaaaagcaacatgaatgccaatttaaaaaaaaaaaaaaaagaacacacaggttttcctgtttctttgggtctttatttcctaattaaatttcctgtgtcacataaaatttacgtatattaaataaatttgggctgggcacagtggcttacgcctgtaatcccagcactttgggaggccaaggtgggtggatcacctgaggtcaggagttcaacaccagcctcgtcaacacggtgaaactccatctctactaaaaatacaaaaattagccaggcatggtggtgcacatctgtaatcccagctactcaggaggctgaggcaggagaattgcttgaacctgggaggcggaggttgcagtgagccaagatcgcaccactgcactccagcctcggcgacagagcgagactccatctcaaaaaataataaataaataaataaataaataaataaataaataaataaataactttgtatgcttttctcttggtagtcgggtaatctgttttttttttgttgttgttgttattgttgttgttaaggggtcctagctatgaatctaagatgggaagaaaagatatttctttccccctatactacgtaagagaaatagttagattcaagctggtattatgaaagactgctttgtagaaaaagaagtcctgcgccaaatcagatttaacaaatgttgctttttcatcattactcagcattctagcctccttcaaaggaaagctctgtaaattagaaactttgatggatatgagttatctgcattcagagaacaaagccatgctttcctatgtttgtcacttcataatgtaagtaatgactccataggtactaaccacagatattagggaatgagggtgggctggtggtggggagaaatgcaattaaaaagacagcacatgtaggtttgctggcataactctcagttttacagaattcctaacaatgtaaattaggcaggtctattaaaatttctatccattctctatactagatgtgtaatctcattagtcttgacaaaggtcaagaatctgaaagtaaatcagcacatacagtagtatgtttcaatttccttcatttataattaagattctccattactgcattttaaactctcagtttatcaaccctaaatctatgcaaggaataagaaatgagcagttccataataaagcaaagtatttagactaatagcagtgtagtatctaagaggcagtgtatagtctatgaggagtaagggcagcctagattaaaagaccagtggaaataaataaaaggtcatgtcattttttttttagatctcacatctcatttacttctaatttttaatatttaaaagataaaggacagtacaagaaattgcttgctggtaatgatggtttggtgtggggacagatgggtgttagaacagataacttatttaggtgggggtaatgggatggagacatggcactgagtggagaactttgacactcatgggttacagaaatgagtcacgtaatcttctttatcaccaacaccatctgctggctctacgaatccaactcttcccactctggattcctttccctttgtcccttcttcccttccactctcctctcagcactctctgatccatccccagtattctatcatcactttcaaagggctgtgggctctgtgggggaattagggacatctatagcctgactttatgaaaagctgccatagttttagtcaactctgagtctaatgcaaaagatttgtcgtttcaaatgtggagcaaaatggttttatctgaattcaagctataaacatcacaaacttgtagaattcaaggatagaaactctgaaaaactaactcattgttttaactgtcacgtatacaaaatgatctcttatgaaagaatcaccatttcagaaagctttcagaatcaaatataattatgattacctctcataaggaggctagataatcaggacctcatcatgaataaaagttacattaagatgggaaatcattactaagtaccagaataaaatgtcttgacaagtaagtagtgtttgagtttttggtctaaaaattatctagggaaaaattcttcatataaagatttaaaaaatgcaacattttattacatcatatggaaatatttgccaatattatataatattggatgatggactctatgacttattcattcatttcacaaatattgagtatgtactatatgtaaatattgtgcatatttacaaaaataagatgcgtattctgcataaaattgttgtaaaaaaatagaatttatgctctctgaaggtagggatttttttttttttttttttttttttgtcggttttgttcactggtgtatcctcagcatctggaagaaaggccagcaacattttccttgtgaagggccagatggcaaatattttagcctttgtgggccacatatggtgtctgctgtatattcttctttgtttttacaactctttaaagatataaacaacattttagctctagtccatgggctggatttggcccactgaccatagttggcaaacccctgatctaggtcattgccaagctttagtaagagcacattgaacgtttgttaaaaatcaaaaatgtattcaatctccacaatgtataagcaatgtgaaaacaacaaagatagcatagttgatgccctccaagaactactggataagaaaaggagacaagtggacagaactatatacagcactaatgatagtcagggttacaagactcaggaggaaagctggaatgaccaaataacgtgacactcgaactgactcttggacatgacttttaatgaaaaacagttcaaatgagttgtaggtggaagaaggttctaatgacttgaattagaggggcaattttggaactcatggataaatatgtaatcgtttcaacacctttcagaaactataagccaagaaagaattatggcaccagctgaggttacaattttatttccttttagtttaccatctgaaaaaaaaaaaaaaaaaaaagggctgggcatggtggctgacgcctctaatcccagcactttcgggggccaaggtgggcggatcacctgaggtcaggagttccagaccagcctgaccaatatggtgaaaccccatctctactaaaaaatgcaaaaattagccgggcttcatggcgtgcgcctgtagtctcagctaccctggaggctgagacaggagaattgcttgaacctgggaggcagaggttgcagtgagccaagatggcgccattgcactccagcctgggcgacagaatgagactccatctcaaaaaaaaaaaaaaaaaaaaaaaaaaaaaggcactagatagccagaaacattatgctgaaaatcaaggaagctactcttctttggatgaaaatgatgaactcagtggtttggtttgggtaacatacaaatgccactgttaaagctatgaggtggaaaaagtattgtagctatgacaaatcttgaattcttgcaaggttggttgttaactataatcaaagcagtacaatccaaaaataggagggaattggaaatatacagagccacatcaacccaacaatcctcttagaatctgataaatagggaggacactgacaaaacagactgttagtgaaactgcatctcagcatttttatacaaattatttgacatttttagtatgtcagtacaggtgtggagttggctttgaactgctgttcatttaggttataacagatgcaggagatttaaaaaaatccctcaacttactgaaaagataaatttaaatgttctaggattgatgagttaaaaaaaaaaaaaagccctacctcatttgctgcattatgcttcagtgatcaccatggcagaattgacctttctttattaagtactgcatatgttcattctttacatgacatccaaatggattcaaaatgtgatgaggctattggctccattactgcaaactccaggttgctcatttgtgcaaaagaggttgttcaattcatgttttccctaaatctagtactaatctgcacaatctaagatgtttgtaatcctactcaaatgcctccttgcttccagctgtgtttgttaacatggcttctgagtctttgggttttttcccctacattacataatgatggatgtcctttccctggttactcccccttgttgaaagtaaccattgtcagcagcatggcctaacatgactggtatcatgccccgtaatgatgatgattccaaagcagagatgacatagaaaagagagggcagcatcagtcacagaagaagaggcctgctctgcaatgtaggaatcaaaaactctttaattgcaaagtattgagaattttagagacataattgtccattgatgtttgaacagattaggatgactattttgtaccccatcctctagatttccaattaggaaagactacatatgaaaatggtatcctggcatttggctgaaaactgaaccacaattctaacctatgtttattacagccgtgtgatgtattttataccatgtcaatgtgtctactaagaattcactcagagattcatagaagaatccagtttaggttgtgagaaagaatgcagtagtgtcaagttcatcctttgggaacacactcatctctgaaaaacctgaaattggtgctgttttttctattactaaatctttctgggtttaaacagaaatgcattaagtttggatttctcctacttacctggcatcacttctgacacagaaactgaccaagtaatagtcaattaggttgactgctgtcattttgcatgtgaaagaaacagtaagtacaggatctgcttcacaaaggcagctccagtgagcaatgacttatttatcacagacatttatatggatgctagaaaacagatgtaggatccttgcctggcagctgacttacatgaaaagggcattttgacagccaatgacattataatcttcccttgctgctgtacaaaaaaagatttataaggcagcagaaggtaaaataatctatttacataatatatacttttaaaagcataattggatcgacattggtcaataattgggcagggcagccaagcattatcacaggctatatatttcacattttataagaaaaagagcaagaaaaatcagaaatcccaaaaagcctaacaaagaaaacatctgggaagacaagtagggtaacaattcaggatctttctcgttacagtaaagtctctactatacagcctatctaagatatgaagtgctgcgatcaacttagatgtatttatagataattgccagagatattataaacatagctcccatttccaagattttgaatattaaatatagttaaaaataaaactaggctgaacataatagaaatatttttcaatagctcaaaaggtacattggggcattacactgtcttggggccatcattagacacatcactcatcactacgttgcaactatacaaatgtgctaaataatagagagttcttccatttaatgtgaggctacttaacatagctgactatttagtttgaaaaaaaattctgaagcaggttgaatgcataaaattagacctatggcattttagcctgtttacccataaaaagaattgtttttggataattatttcagccctttctttgcaattctcttatttttgccactgggattttcttaattttctttctggtctatatgtgctccctacatacttttaaacattttttcaccctgtcctttaatttctttattgatctcatgagcgttctatcaaggtcctcttttccccatttagggaatttcattttcccatggacttcttgtgccattgcttaaagtagagaatggggaaacaaaaaggtttgaggttatctccacttgaaagattggactgaggatcaagaaatctgcattatagtcccaactgtcgttagtttgctacatgacctggagaaaatcccttcaccctctctgggcctggttctcctcttctggaaaatgaaggatttggactatatgacttctcagagtcctttgagctctaccataccacacctatacttttgtcagcagaatagcaattatgcagggcagttcaagtgcatgtaaaccttgcctggagacctcaggatgtgagcagatctatttagtacataatatgtcaattcattgtgattccttcactgttggccctttggagtatttctaccactggtataatttcccgaggaaagggattatttcttatttatctcagtatcctcagcacttagtaaaatgtctggaacttagtaacagttcataaatgctacttctactttgtgcttccatatctcacagcattttctgtccacaaatatttgtattatagaagtttatcacatttacaacttaaactattcaatatctatgggttctgcctacttaattactgataacacccagttccttggaatacaatattttcctgcaaaatggtacacataatgggaacaacactattttcagaaagaggctggactgactcataagggaatcaacgttcacttcctaaataattcactaaaacttactggtaagactcaatgtactgttgcactgctcacgttactagaatttcagcgcctacttgaaattgtgacttgcagaggcaaaggcttaaaaagccatacgttttggaaatatttgaaaagatagctacagaaataataaaaagttctaataatatgtttctgttgctcaaattccagaagtaagtctaaagtggtatactaaaaattactgtcacaacttacatttgcaattaacaataagattttgcaagaaaaatctattaaaagaactcagattcatacactgatcttgcaaaatgagaaaataaaatctgtagacctgttacagacctcaaattaaaatactggtatttgtttgggccactttgttaaagaagtatgctttctttgcctcttaaattttacatttctaacatttaatggtgattaattgtaaaggacacatgtaagactataatacagctaaatgatgcatttgtaattcatgtgaaacaacataattggttctccaagggttcatcaatatattattctactaaacagaatccttgaaagtcccgcctgagttttaaatgcaatatgaagcctttattttaagcatggcttcctctgtgtaatattctcataattattttccagcaacaagaaatattaggttgattatttttattctagctgttagtccctcatgctgcgaagaaagcaagttcatgaattcattcatttcaatacaaaacagacattatttggagagctctatttaaaataaaaaaaaataaggctggacacgatggctcacgcttgtaatcccagcactttgggaggccaaggtgggtggatcacctgaggtcaggagtttgggaccagcctggccaacatggcgaaaccctgtctctactaaagagacaaaaattagttgggcttggtggtggatgccagtaatcccagctactcgggaggctgaggcaggagaattgcttgaacccaggaggcggaagttgcagtgagccgagatcacgatgctgcactccagcctgggcaacagagtgagactctgtctcaaaaataaaaaataataaaataaaataaattagaaaatatcttttcaaaaatttcataagaggtgaaaagttgaattaaattattttaaaagcccgctttattaaaaggcatgtaatatttctattgcctcccccaagagaatttctatcacacaacagtatataaataaacagaagtcagttttaagtacagaatttgattcatggaaataaattacgatcttttaatataaagcaacattttagtatatagtaagaaaaaaacaaaaggccatattcttcactttgatacctgtcactatgtagaagacaaattccttaacatacttgtcttttaaaaataatgtcagtatatgtttgttaaacttttagatataagttaatgaagatcatacagcttatacatctcacaggggttctgcctattcttgcaactactgcctgctaattgtctctagaaactctaaaatttgaaatatatatagtgcttttgaaaagagactagatgaggtcattctatgcctttttccttccagactttcaggtaatctgattttcagccactgttctcagtttatttacaaaatctatgactcaaagactagtatatatcttcgtacagtgtggtctgtcaatctgactagctctgtacgtaaaaagagtactcaaattagcaagcataaagccactgggggccattcacttaaatgctgccaaaaggactgatgagacttttattcctgatgctgaacttggggagggggaatggtgggggagtgtctgctaaattcattttagacaacaacggactacaacatctcccatatattagccatctttttaattaaaggatagaaaatggaaggttggaataaaaagcaaaaggaaggaatagaagtgtagattcaacaagacaagacaagaatgccatttcaaaacaatttggcatatttggagaactggcaaaggaggatttaagaacacatgtcccagcagccctagaatgcacttgcaaggatatatatatatatatatatatatatatatatatatatatctccttgaatggctgttgtgaaatcagagtgtacttctagacattgttacccatgtctagaatatgtatagcaagcggtacttcaatattgataacaaggataaattaactgaaataatagatagaaatgttctacgcaaaagcagagaaagctttttattttgaaatctaagctcattcttaggctatgtaaaatttaggataatcagtctggccctacaggtgtacaataaggacaatgttggagacttgaattccttcccccagagcatgagtgaaagtctagttgagtctcagaaacaaaactggcccccttttaaaaattattccttaggaagtttctagtgcagtgacaaataaaactaggcactttgctatcctcttgagctaggcttgctcttgttcaatttcaaacgagttctcttgagtctaagctgagaccacagtcatcttgaaggacaaaggaaaaattgcttatcttaggctttcagagctcagaaggtgaaagggccccaagagaccaacctgcaaatcataccagctgtgttgggctgtaatagcagtggaacccatgagcagtaaacacccaaagattcagccagaaatctacatacattatatagagttatcagagccctttaacttacccagcacttttacccaatgctttttacacaagacatgtagcaacatcagaaaaaataagtgttcagtggaaacacattgggaaatgtggttctaacaaacagctagcccatatcgcatatctaacaaacccagagtaaactgatctctgaatgctgtgaagattcatgggagtattcttagataaccacctatgccatgtccagccagttggtaagagagcaaggggaattcagtgaggactttcttctatgctaatcacattaatgtgggatttctgctctatttacatagtagaaatggaaagaaagacatgttgattcataattataattaaagttatcttttttatggctgcatagtattccatggtgtacatataccatattttctttatccaatcaactgttgatggatatttaggttgattccatgactttgctattgtgagtagtactgcaataaacatatgagtacaggtgtctttttcatagaatgatttctttccctttgggtagatgcccaatagtgggactgcagggctgaatggtaggtctatttttagttctctgagaaatctccaaatctattaagtacaatggtcactatttgagtgacaagtacactagaagcccaaatctcaccattcaatatacctatgcaacaaacctgcacatgtacccgctgaatctaaaaatttgaaaaaagctacattaactctcccaataacaaaaagggagtcaacaaccagaggttattcattaatgtatcacaactgtaagcttagctatccctggctgtgctattttaggtgcctcatggacaaaatacagcatttggtttataaaatgaccctacatccagagatatagttaatgtacaagtaataaacaaggagatattctagaagataagagacacaactgaattgatcccagaacacaaatgaggaattaagagaaacagaaattcccaatatattcatgtcatttaaatcaatacaggaataattcaccttctccttggatctaccttctgatatctgccaagtccctgaggcaaaccacactctggaccagtgactggcctcctctccacttgcagacagatagctggctatctagtctctagacactaccctctggtctgtcagattagtaatccaacctgtaacctttagcatttaccccactctaggagtcagtcctcagggaacttctctgggggttcactatacctgctttgatcctcagacaatctcagatatgctactgacaccacattacatcttttaaaaatgtacttttttcacattttaacatctctgagactgagatgcatctaacaatcattggtgtgctgtgatttcattggcagcatcttttcctttctcaatggtaaataaattaatgtaatatcttatgattgatactatctttgattcaatgatatatagtaaaagtaaacatctagtacctcaagtctcctgatgtaagggctcaatatacagaatattctgtaaataatatctctgttgtactactctcttctgagataccttagagtctcctgctaaagaggtactttacatataggtcacaatgtttggtttcgtatgaccccaatcataagagattagataatgagtacgtaccaaagaaaactatctatagattgccatgagagatttttccagcagaaaatctctgctctgaaccaaacaaaccaaatttttcttggggtaacttaatgagacacatgcagaaacggatatgtatgttaggcagaagcagaagctaagagagagaggatgttaaaagccacatggcagtagaaaccataaataagcagataccctgatatagaaaggagaacagagagttcattcattgttaaggaaataaaagaagaattagatagacagaaaaataaaaatgcagtagctgagacaccataatggcaaatcataagaatagaaggattagtaagttacaactggaatcaagcacaaacctgctcctaaaggaagactaccagcagggtggtcaatatgtcagaggtgctgtcagacttccagagccactgttgtagtcagaacattctagttttgatgagccatggctgggagaccactgtgatatttcttcctcatattttcttaaccctatattacctttaaaaactttagcatgcctctattccttggaattagaaaaagactgttatatgatatatatatacatatagagagagagactcactcactcattttaacccttcccttacacactttggcccgcaatttctttcttaggggaaaagacagagtagagaatgcttccaatataccagtggcatgatattggctcactgcaacctccaactcccgggttcaagcaattctcctgctgcagcctcccaagtagctgggattaaagccatgtgccaatatacctcgctaatttttgtattcttagtagagatggggtttcatcatgttggccaggctggtctgtaactcctaacctcaagtaatccgccaaactcggcctcctaaagtgctgggattacagacatgagccactgtgcctggcctccgttacacaatattaagcaactataagaaagcaaaagatagggtacaaagagaatgtggtaaaaaaaaaaaaaaatgtgatcagagcttacaaattggctgagccagggaagagaagaggaggttaacaggggtgatctcaaaacttgagagacagaagggaggcgtgggggtgggggcagcacacacaggccagagatggagtgccaactccattttatctttactttttattttctgaagggtcattgacatatagcacagattttctgcaatgatatcttatttggtcctggccaaatcttaaaatttggttcaaattctccttcctttcagtaatactcaggggaggtcatgttcagcttaccacctttcctcaaatcacctttggactaatcaaactcagacttccttccagtcaacaaatctaacaatatttccacttatctgaatgaattcagttaagtcaacattgattaggatagtgttttcttgtccaacataccttatacgggcccaagctcatcagattgaccactaaaaaaaactacaactcaaagttgtatttttctatttattttgaagtttttaaatataaaaatgtatcagttttaaaatttcatttatggaacataagattattggaattattatctcccttttcatcaatcaaaatctaattcatggctgggtgcagtggctcatgcctataatcccagcactttgggaggccgatgtgggcggatcacctgaggtcaggagttcgagactagcctggccaacatggtgagacatggtgagtgctatggcactccccccttggtgacaagagcaaaactccgtctcggaaaaaaaaaaaaaaaaaaaatctaattcagggctacagagaactatttacccatggaagaaccaatctgtgtgagagtattagaaaataactatattcattcattcattgtgttacctaatgtgaagatggaaaactaaagcatgcttatgttttctttttttttaacatatgaacaaatttaagaatgaaaatggtacttgctgggcgtggtggctcacgcctgtaatcccagcactttgggaggccgaggtgggtggatcacctgaggtcaggagtttgagaccagcctgactaacatggagaaaccctgtctctactaaaaatacaaaattagctgggcgtggtggcacatgcctgtaatcccagctactcagaaggctgagggaggagaatctcttgagcccgggagatggaggttgtggtgagccaagatcgcgccattgcactccagcctgggcaacgagagcgaaactccttctcaaaaaaaaaaaaaaaaaaaaaaaaggtaccaattcaaatttgttacccttgatctttataaaggtataattctattactttctttagtatttgaattctagcagtaactttctgggatagtttctgccccttaaattcaatgcttttcttacacttctcttctttggttttgaaaaacaatcacagcttctttcatttaggtatctttgttgctgtttctatgttttgacaatatggaatgaggtataatttatttacattttggggctacctaacaggtaatgatgtgctaacatatcaaagtaaaactctccagaaatggtcattcactatagatattaccatgtaggggaatggttaaaatgaaacaaaacagtaatcttggctcaggtatgtatttgtcagcaggatgagaaaagtttaaactgtatatttaatatgtaatagtattgctttgaaaacaagttttcaaaaacttttatcacctctctttcttacccactcatcaccttaaaaacatttaattcacattccaagatcttattttccatcatattcattaataaaacttaatagtcttgggaattttttactgtcatcatttagaccagtggcctataaggggtttttgattttatattagatctcaaactgtctgcagggaatcctgataccttggtaccacttaaatatagttttttgctttaacagtgatgtgtagaaagggaattccagatggccttttgtaatgtagtcactcaaggagaaatccatagacaaacttgcattaaattatattgctcatctaagtaaaggaaacttctcatttaaataatagcttgctgatatcatcaaaatggtgaaatagaaagttccatctcttgttctcccatagaaacaccaacttaacaatgtagaccacaatacctttatgagaagaccagaatccttttaagaggttgcagtacaccagagaaacacaaaactgaaaaaactctactgaaatgagtaaggagcaatttcactttactagtattagccccttcccccaagccatcacagctcagcactgaaaaatatcactttggcccacagtttctttctcaggggaaaatacagagtagagaatgcttccaatgtaccagccttttggtgcactgcctgaagggctagtttctatctcacctcacatgggacactgatagaaaagaaatagcttggatgtttcagggcaattaagaacaaaggaaaaagggcaggcagcttactgtggtgagcatagctctacaagattgagagaaggcacagagcctgatgcttcttccactgtgataggagagaaatggaacatgttcccaacaatctggcctcagtgaaccaccagggtcgggctggattctgtcctgcctcagaagacattagcatggctctatgaattgtgctaggggtaaatccatctaattaggaatcctcccacacaaatccagagaagacacattcatagaaaaggtttgagaggctcctagaatctctagcctagtgaattggttaagctctttccatgtctaaacaagtccagaaagaatgggaagggtggctgcttcctcaaatgtgcagacaccagtgcaaaagtataagaaacaagaaaaatcagtgaaacattacactaaaggaacaaattaaatcgtaatacacaactctaaagaaatggagatctatgaataggctaacaaagatttcaaaataatcatcttaaggaagctcagtgagttacaagagaatatagacaactgaacaacattaagaaaataattcagcaacaaaatgagaatgtcaacagaggtagaaattatgtatgtatttatttatttattgagacagagtctcgctctgttgcccaggctgaagtgcagcagcacaatctcagctcactgcaacctccgcctccctggttaaagagattctcctgcctcagcatcccgagtagctgggactacagacatgggacaccatgcccggctaatttttctgtgtgtgtgtgtgtatacatatatacacacacacaaatatatacatatatataaatatatatatatacacacaaatatatacatacatatatataaatatgtttttcaagtagagatggggtttccctatgttggccaggctggtctcaaactcctgacctcaagtgattcacgcatctcagactcccaaagtgctgggattacaggtgtgagccaccatgcccagctcaggctggtttttttgttgttgtttgagttgcctttttctttttttttgagatggagtcccactctgtcacccagactagagtgcagtggcacaatctcgggctcattgcaacctttgcctcccaggctcaagagattctcctgcctcagcctccccagtagctgggattacaggtatgtgcaaccacaactggctaatttttgtaatttttttttttagtagagatggtgtctcatcacgttggccaggctggtctcgatctcctgacctcaagtgatccacctgccttggcctcccaaagtgctggattacagacatgagccaccacatctggccctaacagaggtagaaattatttaaaaaaaaataaccaggccgggtgcggtggctcacgcctgtaatcccagcagtttgggaggctgaggcaggcagatcacctgaggttgggagtttgagaccagcctgactaacatggagaaaccccgtctctactaaaaataaaaaattagccaggcatggtggcgcatgcctgtaatcccagctactcaggaggctgaggcaggagaatagcttgaacccgggaggcagaggttgcagtgagccgagattgtgccattgcactccagcctgggcaacaagagtgaaactccgtctcaataaataaatgaataaataaatgaataaataaataaataaataaataaaaataaccaaacagaaattctggttcagtgactgaactgaaaaatcactacagtgattaaacagcagacttgattaagcagaaggaatcagtgaaactgaagacaagtcatccaaattatgtagccagaggagcaaaaagcaaagaatgataaagaatgaagaaagcctaagctacttactgaacatcatcaagcagaccaatacattcattatgggaatctcaaaggagaagagagatagtcaggggaaaaagcttatataaagaactcatggaggaaaacatttcaaatctgggcaaggaaatggatatccagattcatgaagcccaaagaatgccaaattagacaaacccaaagaagtctacactgagatacaatataatcaaattgcacaaagtcaaagaaaaattttaaaggagcaagagaaaagtgactcgtgatgtaaagtgagtcctcaataagactatcagtggatttcttagcagaaaccttgcagaccagaaggcagtgagcttataatattcaaagtgttgaaagaaaaaaaaatgccaatcaagaatactatatctggcaaaattgtccttcaaaagtgaaggtgagataaagacttttccaaacaaaaggcacgggagttcatcaccactagacatgatgctaacgggagttcttccagtagaaatgaacagatgctaaaacagtaacacaaaagcatatgaaagaatacaacacactggtatgggcaagcatacagacaaacacagaatactatatatatataatatagatatagacatagataattttttttgagacagggtctcattcctattgcctaggctagactgcagtggcatgatcacagctcactgcagcctcggctgattctcccacctcagcttcctgagaagctgggaatataattgtgcaccaccatgcctggctaattttttgcatttttaatagagacagggttttgccatgttgcccaggctggtcttgaattcctagactcaatgaatttgcccactttggcctcctgaagtgctgggattagaagccactgtgcccagcccggatactacaataatggtggactgtaaataactttaaactctactattaaagttaaaagacaaaaatattaagattataactacacaaatttgttaatggatacacaatataaaaagatttaaactatgacatcaataacagagtatggtgagggagaagtaaaagtggaaggtttttgtatgtgagtgcagttaagttgtcagcagcttaatatagaactgctgtaactgtaagacaatctatgcaagcttcatggtaatcataaagaaattaactatagaagatacacaaaagaaatagaagaaggaaccaaagcatatcactacaaaaaatcaacaaatcacaaaagaagatagcaagagaggaaaacagggacaaaaagactatgaaacagaaaacaatcaacaaaagggcaatagtaagtccttccctatcaataattacttgaaatgtaaatggaggcctggtgcggtggctcacgcctgtaatcccagcactttgggtggatcatgaggtcaggagatcgagaccatcctgggcaacatggtgaaaccctgtctgtactaaaaatacaaaaattagccgggtgtggtggtgcacgcctgtagtcccagctacttgggaggctgagacaggagaatcacttgaacccaggaggcggaggctgccatgagccgagatcgcaccactgcactccagcctgggcaacagaacaagactctgtctcaaaaaaaataaaataaataaataaatgcaaatggattaaactccccaaacaaaagacacagagtggcagaatagataaataaacaatatctaattatatgctacctataagagacaacacttagctttgaggacacacatagcctgaaagtaaagagacagaaaaagatattccacacaaatggtaaccaaaagagagcaggagtggctatactttatgtgacacaaaatagactataagtcaaaaaccgacatagaggcgaaaaaggtcattacataataatgaaagcaattcatcaggaagatataacaattataaatccatatatacaccaaatattagagcatctaaatatacaaagtaaacactgacagatctgaagtaggaaacagacagcactatggtattggtaagataattcatatcccacttttgataatgaatagaacatccaggcaaaaaaaaaaatcaataaggaaacaatagacttgaacaacactaagagcaagaggaactaaaagacatacagaagacatttcaaccaacagttgtgaaatacacattcttctcatgcacacatggaacattctccagaatatatcacgtgttaagtcacaaaaaaagtctcaacgaatttaagactgaaatcctacacagtatcttttctgactatagtggaatgaaactagaaattaatagcagaaggaaaattggataatttacaaatatgtggaaatgaaacaacacactctttaaaaaccaatgggccaatgaagaaattaaaaaaaaaattagaaaatatcttaagacatgcaaaaatgaaaatacaacataacaaaacttacgagatagagcaaaagcaattctaagagggatatttatggtgataaaatgcctacattaaaaaagtagaaagatctcaaataaacaatctaatgttatacctcaaggagccagaaaaagaacaaatttaggagaagcccaacattagcagaagcaaggaaataacaaagactagagtcaaaataaatgaaatagagaacagaaaagcagtagaaaaaaaatcagtgaaacagaaaattgtttttttctgaaaatataaacaaaatggaaaaatccttatactaaaaaaaaaaaaaagattcaaaatcagaaatgaaagatgagacattagaactgatgccacagaaataaacaggatcagaagagactactatgaagaattatacaccaacaaattggataatctcgaagcaatggttatattcacagaaatatacaacctaccaagggtaaatcatgatgaaatggaaaatctaaacagaccaataacaaacaaggagactgaatcagtaatcaaaaccctctgcaaaaagaaaaatccagcattagatggtgtcagtggtgaattttatcaaatatttaatgaagaattaaccccaacactttttaaagactttaagagagtagacttcgaaactcattcaatcaagccagtattaccctaatacaaagtcacagacactacaagaaaactacagaccagtatcttcgatgaaaacagatgtgaaaattcccaagaaaatattagcaaaccgaattcaacactaagttctaaaaaatcatacatcatgatcaaatgggacttatccctaatatgtgaggatggcttgaacatatgcaaatcaattaatgtgctacaccacattaatagaatgaaggataaaaatcacacaatcatcccaatagatgcagaaaaagcatttgaaaaaattcaacacctttccatgataaacactatcaataaattagacatacaaggaatttacctcaacacaattaaggccatatatgaaaagcccactgctaatatcaaactaatgataaaacacaaagtttttcttctcatatcaggaaatggaaagaatgcccaccctcaccatttatattcaagatagtactggaagctctagctggagcaactagacaagaaaaagaaaaataaaagacattaaaattgggaggaaaaaaaaaagaagtaaaactatctctgtttgccgacacgtgatcttacatagagaaaaccctaaatattccacaaaaaactgttaaaactaattaaaaaattcagcaaagttgcacgatacaaaatcaacatacaaaaatcaattgcatttctgtacattaacaataaagtactgaaaacaaaactgagaaagcaatcccatttgcatagtatcacaaagaatgaaatacttaggaatacatttaaccaaggaggtgaaagacttgtacggcgaaaactacataacgttgatgaaacaaattaaagacaacatatataaatgaaaagatattcagtgaaagacttaatattgttaaaatgtccatactacttaagataatctatagattcaatgcaatccctttaaatgtcccaatggcatttttcagagaaatagaaaaacccatcgtaaaattcataactacaaaagagcatgaatagccaaagaaatcttgagaaagaagaacatagctggattcgccacacttccttattttaaaatatattacaaaccttcagcaatttaaaaaatatgggactgacataaaaacagacatgtagaccaaggaaacagaatagagagcctagaaatatatccatgcatatatggtcaactgatctttgtatggggtgccaagaacacagaatgagaaaaggaaagtctcttcaacaaatggtagtgggaaaattggatatggacatgcaaaagaatgaaattggaccttcatcccacattatatataaaaatcaactaaaaatgggttaaagatttaaacgtaagacctaaacctacaaaactccttgaagaaaacaaaggggaaaagcatcatggtattggtctgggcaatgatttcttggatatgacaccaaaagcataagcagcaaaagcaaaaacacagtgagattacataaaactaaaaagcttctgtacagcaagcaatcaaaatgaaaaggcaatttacaaaaatgagagaaaatatttgctagctgcatatctgataaagggctaactatgcaaaatgtgtcaaatacgtaaggaactcaaataactcaagatcaaaaaaacaaaacagctgggtatggtggctcatgcctgtaatttcagcactttgggaggccgaggcaggcagatcacctgaggttgggagttcaagaccagcctgaccaacatggagaaaccccatctctaataaaaatacaaaattaactaggcatggtggtgcaggcctgtaatcccagctactcgggaggctgaggcagaagaatcgcttgaacccgggaggtggaggttgtggtgagccaagattgtgccattgcactccagcttgggtaacaagggcgaaacgccatctcaaaaacaaaatgaaacaaaacaaaataaaaaacaaaaaagctcccaaatagccagtttaaaaaataaggaaaggttttgaatagacatttctccaaagtagacatacaaatggccaacaggtatgtgaaaagatgctcaacatcactaatcaaggaaatgcaaatcaaaaactacaatgagatgtcacctcaccccagttaggatgtctactatttaacaacaaaaaaaaaatgtaaaaggcattgttaaggatgtgaaaaggtaacaagcactgttaaggatgtgaagaaattggaacccttatacaactgttagtgggaatgtaaaatgatgcagccattatggaaaagagtatgaagcttcctcaaaaaattaaaaacagacttaccagaagatccagtaatccctcttctggggatatgtccgaaagaattgaggccgggcgcggtggctcatgcctgtaatcccaaaactttgggaggtcaaggcaggcggatcacgaggtcaggagatcaagaccatcctggctaacatggtgaaaccccgtctctactaaagatacaaaaaatgagccgggcgtggtggcacgtgcctgtaatcccagctactcaggaggctgaggcaggagaattgcttgaactcaggaggtggaggttacagtgaaccgagatcacgccactgcactccagcatgggtgacagagcgagactctgtctcaaaacaaaaaaaacaaaaaaaagaattgacagcaggatctcaaattgatatctgcactcccatgttcactgcagcattattcacaacagccaagatagggaaataatccaaatgtccatcagtgaatgaatagagtaaatggagaaaatgtggtatgtacgtacaatggaatatgattcagccttaaacacagaaagaaatcctgccatatgtgacaacatggttgaacctggagacatatgctaagtgaagtaagacaggcacacaaagactcatactgcgggattccacgtttatgagctatttaaaatagttaaactcacagaaacagagtagaatggtggttgccagggtctggggagaaggaggagtggggagttgctgttcaacaggtataaagtttcatttgtgcaagatgaataaattctagagatctattgtatggcatagtgcctatagttaacaatattgtattgtgcacttaaagatttgataagagggtagatctcttgttaagttttcttcctacaaccaaaaaacaaatatagccaaatttttaaaaaggaaaaataacagcttgctgtttctgagaggtaaacaagtgactacctacttgcactgggctagtaggcatatatgtagtatatgaataatctgggctaaatagtatgtgtaaatatatcactagcaataaaatcaaggtctgtgaataatttttagtcaatgcttagaatggccacaggtagcacaccaggaaatggctaggaagtgctcccactgcctgggtaattttataagtcatttgtaacatatatactgttctggtaacagataaaaccctaggttaggtttatctttcatttcttatagctctttttctctagcacgagaatccaaaaagtacttagagaacactggcacaaagaagggtgtatcaaaaacaaatgttactcttttggtctagagtaactttagaggataagtttaggacactaaaactataggtgtgctggaagttccataattgactttcaaatgctattttccagtagtcaaaactactcatttgcttaagttatggagtatataacattgcaattgaataataattatgaaagacattgccatttccatcaatatttttattttaaattacaccgggtatcttatttttttaagagaagcccaaattaaatgcagtttatttttcttgaaaagaaatgctgatctctattcatagcctgctaatagcattatttctttttttttttttattttcggtacacacagaggaacagaagggaggggtgtaaaggaagggagtgttataaagacttttttgtagaagtgggattttttgcaccttcaattacctcatggcaggtgcaatgaccactttgtgctctcttgaggacaaaagtggcaatctgtacttacaaatacatgatcatatcagtaaaaatgaggccatgctgaaaatttgccccgagatgtttaaaggacactgaattttgactcagatttacacataagtcaatgccaaatgacaaatttcaagcttcacaagttcagacattgatcagggaattggagcttcaaagccataaagctgaaagcttttggaccaaggaatattcaacaaaagctgtgtaaaaatgcatcaatgcagtgtgatcacctcaagcaaaaatcagcaaggcacaacaatgaagaattcaaatttaatctatcttttggacttccttggaaaatgagaatacaatcacggtcaaaagttgataacattttcaaatgactttcagtccatttgaataggtatgaaataacaccatttgtttgtatagcatttagtttataaatgcttcctggatacattaccacatttcttttcacttcaaggctgtgaggtggggcaaatataattatccttattttatagatgggggcactgagggttaagaggtttgtctgaagtaacagagctggtaagttttgggattagatttttaaaaaaaaaatctagtgatcttttctctattttaggctatgaagacaaagaatctgccagtttagacgtggtattatttgatgaattatctttgggtgtgagacaggtggtgctactagtcacactgtgaattgccttcggtatttacagtatcacattgacatcccagacatttttccctctcattcatcaagttcagtacctaaatggtctttaattacacattcagatgtgaataatgtatatatctagttatttacatagagttggtattaataagaatgttctgctctatgccagtaagcatgtgctactactttagtttaaaatagtttgtttccccactgggtaagatgaagtgatggggatgatatttaatcttttcttttcttttttttttctcgctctgtcaccaggctggagtgcagtggcgtgatatcgctcaccgcaacctccgcctcccaggttcaagtgattctcctgcctcagcctcctgagtagctgggactacaggcacgtgccaccacgcctggctaatttttgtatttttagtagagatggggtttcaccgtgttagccaggatggtctcgatctcctgacatcgtgatctgcccgcctcggcctcccaaagtgctgggattacaggcatgagccaccacacctggcctgatgtttaatcttatacatccttgagacatggaaaagtaccgtctatgttaatataaaatggaaatagaaactattatttacaagggcgcaatatgaacaacccatagaaaagaacctatttctaaatcataaaagataaacaatatcaataatattgactatgtattgatattagaatcaccagctactgtgctgtgttttatattcgttatgttatttaattctcagaataaccctattaggtaggcattgttacatacatttcatggatgaagaaactaagttttagaaaggctagataatttgcctaagtttacacaactagtaatggtaaaaacggaattagattccagttgatgtaattaaatattgctctttaactattatgtctctggtattcaaacttcagtagtatgtagaaaaatgatctgggcacttgttaaaatgtagattcctgagcactatatactgtgattcaagacctggggtatggtctgatactctaaatttttaaacaatttatgattgatatataataactatatatatttatggggtacaacgtgatgttttgatataggtatacattgtataatgaattttagtaagtttcccaggtaattctcatgatttttttaaaagattttcagaaatactgtcatacattatactgacagctaacactgtttcctccatattaattttggatgaatcttttaaaaataagtcatacatttgagggttttggttgttgctgttgttgttttaactcagaaaatttaatgtctcactgtagttgagaaccttaccaggaaaacagaaattgtgatgggacggtattgatatttgcataacagctgcatatgtatgacacattcaatgaggccaaacaacaggctttctctgtaggtataagtagaggcagctagctaggtacgtaaatgaagaaaggagaactgaagatagaagggagagggaagaaaagagagaaaggtaacaaagttaaaggactgatctacttttgaacacaagtatatttctctcaaaagacaaacaggttctgattaaaatttgtgttttgacagctatgtcttttatctggtttgtttaggttcttaaatggaatgacagggcatacaatccaattggcagttgtgattaagaggtcaggcagtgaattcagtactttaaaaaactctttctctctctctctcttttgcccccttcaactggcactttagtttcctaacttattcatatcagcaggaagcaatggctgaacaccaacctctactcacaaatctaaggacaagcttcattattacctattgcttcaaggaaattcagtgatgtttacataatccgggcacatatatagcttttcagtctcaattattgttttctttttctccttctgaactatcaatctagtatgaaaagcttaaaaattaaaaggctttttagaaaagaaatcacttttgtctctatataaaagaagagcaaaaaaggtactcccaaaggacagagtctgttaaaaatcagattatttccaccacactcccctattattcacttgtcagtaaaatatgtcctctcattgtcttggtttgaatgcctatttttatctgactggagctatatggtcatttttgtatttattactaagttctttaggtttctactccccccaccccagagcatgtttttctgctcttaaaaactgggccacatgcctctgaggagaaagtagtgcattatttcattcccaccttttcttcttttttggcatctctgaggctgctatgcccagaagtgcttccactcaagctggaccatcaaatcaattatcacagcagtctgctttctaaatatgaatggcaatgaatgacaacaggaaaggcaaactttcaactttgatttgtcattggtaatgcaaatctttttttttttttttctttttggtcccctcctcttttccttttatatctctctcaatttctccctgtctctccctctcaatctctgtccctcacagatgtttgagagagtccagccatttggccaaattctcccccctgctgttggcagctgcattgtatcaaatcttcaaatgaaagcttcacctttgtgagtcaaagtcacaagagaaaaatggtatggggagccattattgctataaaatctctttctgctaacctctgagcctgattattcctgcatctgaagaagcacaacaatgttgcatccttattcattcgggctgtttaaaattcttgcctgctccagtatttgaagcttcaattgttttgtgcttaatgttgctcatttcatatcaagttcttggttatgtgaaatactttaatttttaaaatgttattatatcctagctgtttaaaaagattgagaatgccataaagagagagactggtttaagcaaaccataactagctttcataatgctgtatgtggtcattaatccatcacttttgtgaggatgtctgcaatttctagtatacttagtgctttacgtttcttttctcaagctgacagcaattcttttcattggccaaagatgccacacttttaccagttatatttataaatattactttaaaaaatgagttcaaagcagtaacatcacttgaaaatggcaggcaagagaataaattatgccaaccactgttaaccagaaattctgtaccagagtcttagaatatattgtcttcatttagtcaaataatgatgagttgtgcaaggctgtgcctagagccaatttaactggtgaattaaggtgtcggctctgtcaaaattagtcaaccatcaatgaaaaatactcaattacaaactactttatgacatgcatacactgtttttcatgggggtgggggcagtagggagtagagatacaaaagagtatgaattataattcctattctctagaatctcattgaggagataatgacagactctctcctttgaccaaacttgagtcagattcttctgagctccctttttaactagacccaaacttaggctctgtccctggctcatttagtcctgttttagcaaaaatactactgggttagtttagtgcagatccctcacccttgattatctgatcaaattccttattcctcactctggatatcttatcatcttggtctgacttcagcaagaatcctgtcaagtcagtttagctggaatgcccttaggcctgatgtttcctcttagtaattttccatcaatcgacccccaccctggttcatggctataaatgtccacttggtacttcttgtgtgtggagtttggcttaatctcactaccgtactacaaaattccactgtagtagtccctctgaatgaagtcagccttaccatatttaacaagtgtcagaataattttttctttaacaataaaacacagagatgtaaaaacaaaactataatatagggtactttttgctaagtgtcaacagaactacatagagagtataagttatgtaattacagcaagcagattactttcaaatggggaattcaacgaagccttgatgaggtagatgggatctgagctatgcatggtgaaagcctgggtgaagttttcataggtagaaagtaagagagattattcccaatggggaagtaaacagcttaaattgatttacacattgtttatttggaaatactatttctgagctcaatattctttagcatctaactttataaatggttaacgaaaaaaggacaaaagaaacatgcataaggtagaagagggtagtcaataatggacaaccattctaagaaacagtctttctgcagcttactcttaggcttgtgggtatgatatgctgggtcaaaggtggctctcaagggatcggtaataattataacaaatgtgatcctaattcagctgatcagggtttgtataagatcggtcctgatctcgtaaggaatggtgagttgctccaaagatcttaatgttctattactatctagatttatattttataaaatatgaagacatcctaggctgaaagtagatgtcctacggtagttgcaagctatgactgttccagtccagagctttatgtattctttggggacttttcctaggccagtgtccacatcttctgtattagtttcctaggtctgccataataaattatgacagactgggtgacttacaataacagaaatgtattctctcacagctctggacacaagaattctgaagttaaggtacagggcagggttggttcttttgaaggttctgatggagaatttgttgcacttctctctcctagctttttatggtagccatcaatccttgggattccttggcagtcgcatcactccagtctatgcttccacagttacgtggcattctccctgtgtgtctttgtgtcccacatggcctacttataaggacaccagtcattggatttagggtgcaccctcatccagtatgaccatatcttaacttgattacattttcaaagcctccaatcacaaacaaggtcctattcacagatactggggattaggacttaaacatacctttttgggtgacaattcaacccataactctttcatagcctattattaaagtactattttcctaaatgggattacttaattccatcccaatgattcatttcccagaattttttttccttttgaaataagcaagttcatataacatctacctaataagctgactttcaactaaaatgggatgtctaatttctaatcgagtttagtacatattagagctgtcttcaaaatctacttcacatagtgaaagcaaggtagtacagtcaaagttacattaggccctgtggggagataaaaaaaatgataaaaaaaaaaattggctcctactctcatatagtttacagccttgaggtttcacagcatagaatgcttgcaatggaagggatcaaagatcatctattctaaaccattcattttatagatgaggcctttgaggcccagtgaggttaactaatttgcccagggctcacaaagttaattggggaaatagaacatgcaagggaaacaaatgaagggcacaattttaaagaaatccagctactcttctgcttttgtgtatgaggtacacagtgaatgctgatgatgtgccatagagattagatcgaagtctggcagtcaaaagcaattctggagtagatgccaaggctcttcatctcctttgctctcatctctgtagccttccagaaagcaaaataacttcctgacctttcttttcctggggcatgggcttaactcaagtttcagttgtctggggaagcaatacctttagagtagaaagcacaaggctgtgctgctctacttgttgtaattctctgatgaccataaactaatggtagagaagtagcccccagggtgggtggggtcgggaagaaaggattcaggagttacagatttgctatagataacagaactgtgatgcacagttcattctttcctgcttcaaaaaggaaatatgtagtataactgattttgaagggaaaaaaagggtaaattgcctacttcaaagacaaccaattgctggaatagctttcaagtcagtttgtaagtcaaagctcttctttcctttctcctttaacagaaaatgtttgatataccaaaaaattaacaaacaaaaaaaacaaaaaactaccattaatgtaattaaaaacaaccaatcactagagttaaagaacaatgaggtaccacggcattctaccataacctaactaaagatttaacagaacaacaaagaaactgaaaaaaatggtaagaaattacaggaagaaaccaagattttgcatatctgtttatttttcaactggcattgaatcatcattaactgagcttattttctctgaattaatggaactaacatttaatctgacttgcctaatatggggataggcttactcctttcttataaaatgtacaagatttaaaattaaagtagaaaagcatcactttccaagcctactgttttgggatgcagcgaacaattaactatgtttctaccaatttattcaaaatttcattcaaaatattctttacataattatatttcttagagctgtttaagaactgcaatttcaaattaggtgatttcaagtacacctagatgtgaattaacataaattttagcatcatcaactagaaaacagagcttcaaagaaaccaagtaacatgttatagattaacataaacaaatgtatataatcagagattcaaagacatagtagaatgtcacattttctttggagttttgaaaaagaataaaatttgacaaataatgcattataatgatcacctccatggatgtctaagcatgggatagaatttttggctttactagcaagaagaattacaaattgaatgtgttaagtgtatgcatatcatgcttctatggggacgattacacaattgtgacaatagcaaaaaaccaactctcatgaaatgatcctccttataagaaacttacaatgcaagctaactttggaaaactccacaaatgaattagtaactagaagagtcactcttccacttattactgacttaggcctggggagctgagatttttgtcatttatgatacagctgagaagaagagctctttagtgtttttttcattagaaacttcatgaagacctgtaattggacaagtacccattacctaggcattaaatctaaattctatagtagtcccacacttcacttcattagtcaaacacacatgcacaaatcaatgcaagatttcataagaaatttatagggaaatataatttcacatgatagttcatcttactgtacttcaatttagtaattatttgattcaccttctgaaaactgtagagctgattcactagtgtaactttttctttctaatacaatggattatttaaactaaaaaggatgtgtgtatatatatacatgtatacacacacacacacatatatatatatagatagatagatagatttttttttagacggagtcttgctctgtcacccaggttggagtgcaatggcacaatcttggctcactgcaacctctgcctcccaggctcaagccattctcctgcctcagcctccagagtagctgggactcctggctaatttttgtatttttagtacagacgggtttcaccatgttggtcaggctggtctcgaactcctgacctcaggtgatccacccaccttggcctcccatagtgccgggattacaggtgtgagccacagcacacggcctatatatattttttgagagagtctcactctgttgcccaggctggagtgcagttgcacgatctctgctcactgcaacctccacctcccaggtttaagcaattctccctgcctcagcctcccaagtagatgggattacagaggccagttaccatgcctggccgatttttgtattattagtagagatggggtttcaccatgttggccaggctagtcttgaactcctgacctcaggtgatccgcccaccatggcctcccaaagtgctgggattacaggggtgagccactgcacgaggccataaaaaggatgtgtgtgtgtatgtgtgtgtgtgtgtgtgtgtgtgtgtgtgtgtgtgtgtgtatatatatatatatatttttttttttttttttttttttttgagacagagttttgctcttgttgcccaggctggagtgcaatggcgcaatctcggctcaccacaacctccacctcccggcttcaagcgattctcctgcctcagcctcctgagtagctgggattacaggcatgtgccaccacacctggctaattttgtatttttttaagtagagacagggtttctgcatgttggtcaggttggtctcgaactccctacctcggcctcccaaagtgctgggattacaggcatgagccacggcgcccggccatgtatattttttaaagcagtattactcattcaattgaaaaaattaattctacagctcaggcttttttgaagtcatatttcatactacaagttctatacagaagcactgtttaagctcttaaatattggttacatttcagaatttcagtcctcagacccagaagacattttattaatttaataaagatttaataaagacatttaattaagattaggcaagatgcagacatgtattgtatacaagggtggcagaaaggacctttagcgtgcctctacatttgccattttgctaacataaacccaagctgaacttcactcattttttatgcaaatccttggctggggagtggcttaagtgtaaacttacactttctaccactaatgtgttaagccaggacttctcttaactccgtgtggaaggtacagctatactttataaccaaatcaaaacaccatagtcaattataggtatatatttcatgactttaactaaaatgtgaacattacttttccaatctttatgttactgtgatgtgactgatctttaaatagacccaaattaatgagaaaatatggacatttcacttagaatgaaagactcagatgataggaaatttgtctcaaatgttaatattaatgtgttgggttctaacaacacaaagctccaattaaactaaattttacatataatatgatgcacataggtagatttctaatgttttcctgatgactcaagtagagtgccttatttttaaaaaactggttatgttgttcacttcaggtttacaatattaatgctattttgtgatcaatttggtaagccctacaatatttcccaaaatgacttatagatgcaacttgacaactcttttacttagctagcatgataattagaacctaaacttgcatttcaggttgccatatcacctatacagaactgacaacaagctattttcttggcaaatacctgattgatggttcattcttagcatgcttggagaaacacattaataagataacccatgtcttttttcactctgtaatatctacagatgatctctatttcagatgactctaagcagctaaacacgaataaaaaagaacacctttctggctcattaaggcaattgctcaagctgtcattagaattatctctctgaaaatgcagtacaggatgcagcaggccttgtctgctgcagaaactaatggtacagagctaccttttgacagcaggactaaatttacatactttacatattcagtgagtaaaggaataatttacaataatcaaatatgctatgtttggggcattttctcctcatttgaaatacatctgtctactttgtaagcctagtcatcgacaaccgcataggaaatgaattaattgagccaaagcaaaaggagaccttttctacttatttaaccctacccattttctatagggcaattgtaaattatgcctcagaagataaatagcaagtcatgcctgaaaagatgagatgctctggttttcatcctcagacctgctaggctgactacctgtcagataaggcagcagccaggattatgccttgaaaagctgacaaaccaagatttttatcattaaatcaaacctgctgggtttaaactctgtgaactttaattatctcatatttaattagaagaactagattaaaccaaaagtggagggtggggggaggtcctggcaaaggagaatcaaggagttatgggggatgcggagacttcatatccacaaatcagatttctcatttctaataaagcaaggtttacatttagaggagattcaaggaatcactgggctgcacaatactagaagttatctagtccatcccagaacgataatcatctaccctgttctttattattactattattaattttttttttttttgagatggagtcatgctctgtcactcaggctggagtgcagtggcacgatctctgctcactgcaacctctgtctcttgggttcgagggattctcctgtctcagcctctcgagtagctgggattacaggcacccgccaccacacccggctaatgttttgtatttttagtagagacagggtttcaccatgtcagccaggctggtctcgaactcctcacctcaggtgatctacccgcctcggcctcccaaagtgctgggattacaggcataagccaccatgcctggccttaccctgttctttaaaatctctgcaggaagaggttctgcatatttgaaaaggtttaaaactaataagggcactataagtcactttaccagagaatgagaaaatgaaaatttttatacttcaccaactaaaagataaaaataatctgttctccagaggttgcttttattactatttttctttatgtaaggcaagacagcataattaacagtactttcagactatcttgtttcataatagaatagagtcataagacaatgaattatttaaccagtaagtactcattgatgatctactccagcagtcggcaaactttccctgtaaagggtcagatagtaaatattttaggctttgtgggccacagagtctctgtcacaattgctcaactctactgctgtagcccaaaagcaggcataaataatgtgtaaatgaataaacgtggcaatgttgcaaaaaactttatttatggagagttgaatttcatataattttcatgtcacaaaatattgtttttcttgtggtttttgagacagtctccctttgccgcctaggctagagtgcagtggcatgatctctgctcactgcaacctctgtctcctgggttcaagtgattttcctgcctcagcctcctgagtagctgggactacaggaacctggtaccacgcctggctaatttttgtatttttagtacagacaggtttcaccatgttggccaggctggtctcgaactcctgacctcaagtgatccacctacctcggcctcccaaaatgttgggattacaggcgtgagccactacacccagcccttgtgattgttttcttaccatttaaaatcataagaaatattcttgctgggcgtggtggctcacacctataatgccagcactttgggaggccaaggcgggcagatcacgaggtcaggagttcaagaccaagcctgaccaacacggtgaaaccccgtctctactaaaaatgcaaaaagttagcagggcatggtggcgggcgtctgtaatcccagctactcaggaggctgaggcaggagaatcacttgagtccagggggcggaggttgcagtgagcagagattacgccattgcactccagcctgggcgacacagcaagactctgtctcaaaaataaattaattaattaattaattttttaaaaaagaaatattcttaggttttggactggatttggcttataggccatagtttgttatccaacggtctcttccacacttaagtcactatgaaggggagagaaaatgatacaacacatggctacttttcataatggttgggaaaacaagacaaaaatattttttaaattggcaaataatataaagctgcacataataaagggctaaagtgtgtggggcatcccataggctaaaagagtcaaggcatgaggaggacatgactctatgagatctggaatagttagaacaggactcatgtagcaactagttgtaccaggaagaactaggtggacttatataagtggagaaaagaaggaaagagcactccagttgagagaaataacataaaccaggatagagaaatgtgaattagcaggttgcatttgggggaatgtaggagaaaggcctgtctaagcagaatcaattggagaaattaattcagtcactcaatagataactattgatcactcctgtgtgtcaagcattatgctaaacactagagatactgtgatgagtaaggcacaatccttgtcctccaattgctcatggtcttgttagaaggacaaacaagcaagcaattataatacaggataagatacttatactgaggtataaagctccctggaaataactatggcaatttaaaaaattatgtcaattctcaacactccattcatttgcatttaaggtagagatctgtgatttaaaccataaagggaatccaaatgcaaaataaaaatccctgtgtgacccacacaaggcctgatcatttaaatattcaaacgtaactgcctttcctagagaaacagcaaaatcacataaacttcctataagtgattttcggaaaccctttgaagattataattttaaaaaggattattattttattagcttgattcactgcaactgggcattatgtcattggtcctaacaatgtgcatacacctatctgtaaacattttcagcaatgaggtaaattactatggaaaagcctgaaagtgttttttcaccagagatctttaagaagaggatttatatctacctgcatgagatggctcaggatcaataatgcctagagcacagcatgaattttcaactctatgatttgaaatctcttaaaagcattccagtgactatttctacaaattatatcactcattttttaaaaatgtagtagtgttatcagacttatttgaggtaagaactaaaaattcagctacaagtgtttagagcactatgaccaaagaaaatctgaaggaaatcataaatcttttgcatgagcccctaagtgaaagggaacattgtaaggaaatagcatgcaggatagaattagacaaactggtgttcagattctgattcagccattcaccagctgcgaccttgcccaagctacttaacttctctaatcttccatttcttcccctgtaaacctgggaaaagaaaacctaatgctcaggaatgttgtgaagatgcaatgagatgctgtacatatgacacctagaacatgccaggaaaacaataggtactcaagaaatgttaaagtcctccactctttctgtgtttttctttccttttttttttttttttttttttgagacggattttcactctcgttgcccagtctggagtgcaatggcgcgatcttggctcactgcaacctccacctcccaggttcaagcaattctcctgcctcagcctcccgagtagttgggattacaggcacaccaccacgcccggctgattttttgtatttttagtagagacggggtttcaccatgttggccaggctggtcttgaactcctgacctcaggtgatccgcccgccttggcctctcaaagtgttgggattacaggcgtgagccaccatgcccggcccattctttcttcattgccagtttcaactcaacttttttaggcaatgaccccgaacaacaggcacaaagatgtcatttgtgtggtaagtgagcataaaagggagaacagacctatgtatgtgtaacctttcttctgtggttattgtgggtagcatgttgtgggtagtgtgacttaacaaccaactctgctatagaaggcacctgttgaacctccccttcctcctgaatccaaatatgcatctgcattctccactttcactctttccttttaatgttctctcagccatggacctctcctcaaaagccagggtccttggtgagcggaataaataaatggtgagaaagaccagaggaaaatataattttcctagcgacacctccattttctacaatagttaagaaatattatttgctttttctcagttcatttccaaactaagtctcacacccttggaatgctgtaataccaatactgccacttgtgaagagtatgtcattcgggcttctctatacagcattaaaatgaggcttcctcaataaataatatatgtggaagcttctctgagctagaacaaccatacctcttttgtgcatagcaactcccatgacctagaagtgcttcctgcagttatgttcttattaagttgaatatttcacatgctttggagctgagagccaagagccgagtctcttgcgtggttgttttttttttttttcttaacacagtattgaaatcttcattatctccaaatattctatctatgtttgctactaaatgtacatgtagtagtgctattgcccaatatgatttctgaatggattaataataatatcaattttatatttccaggtacacaactcacaggattcttaaagtatctcaatagtagaatacgaatatgtaaagaaatcactgtgctatgattcatatctgaaggactgtgatcccacataggaacatgtaaataatcaagggcttaggcaaatgatataaacacatttgcacaagcctgaatgtataaacttcatacatgcaaagatataaaaatatacgcattacatgagttatttgcaattatgtcttaaaacactcagggtatttctgagtgttcaagttaatgaagttcttgaaaatatggattaatttaaatatactaaaattatatattacatatatgtatgtgtgtgtgtatgtgtgcatgcacgcactatatatggctaataactggcaaaaaaccatggctaccctagtggcttttgtctttatataatagtcactccaataatgactagtatacattttaaaaacacattcataggacagagatcatatgttagactgcttttgtatcccacttaatgcctggcagaatgttctgcacaacacagtcatcttgaatgcaagctagaaatattcattgtagactatatatctgttttcttcccaagtctatattttctttccaggcatagatatggttaaccatcatgaaatcggtattaaggggcatatagcataaattttatcagaaagccttaggcagaaagaaaagagcaccagacaaaatgaatatcatgtttccactagaaacttttactacttgattatcttaaaaagtcatgttgtaccatcacccaatcctgtttaaaacagcactcaggccgtttatgtagctgatcttggattagcccttgttgcacagggatgatttaccactgcagaaaagaagaaataaagagaaaaattatttgaaatgtataaataaaaaaacataatgcacctagaacactgaataagacaaaaccataaacagctcatttataatactgatttaggattgtgctactgtaacttaaaatgagaagttcaacaaattaggccacagataatacacaaatctcatatttatttcattagttatcatgcaggtcatgataaacgtgtcacataataaaggaatgaactgcgtattgccagcactccatctcaagctgcattcttgcttgtttctttggaaagttgtaagttaatgaatagatgcgactttctatgatacggatgtccttcactactcgaatctattgaattcagcaatgaatacatattcatgaatgtgaactcttctcaaaacagggatttagacagtctattccattaaacataagtttatttttcttccaggtgtcagctaggaaatcaacattttggtcagtggccttttcataatgtttgtcctaatggatgccacctggaaagaaaatcaactgatatttaatagagtatattttctaaatttccattctaggaagagtattatcttaggaagaagtaattcattctaattattagaaattaacatagattcataaatacaactgtagctgaatctggtgctaattaaaacaagagttaaacaaaaactatataattcactttattatacattcacattctatcgatgataataattagagtctatgctatcatcaacttgatgttttcatagctatactgtttatcttggtcatcctactatggtttctatgtatctgatgaggccaactgtgttttctgtcagtctgttccagttacctgtgttttgatttagtgacttgccacatggatataatgttttacaatcatctaaatggttaatatatattaactaatgttttagtgttaaatgttcacacaaaacctaataaacggtgcacctccaaaccttcttggcttcctttacaagtaatacgatgtttttttttttttttttcacaaagacctttcgaatattcttctagtcatgctcaatcagtaaatacaccaaaatcaaacctaaataataggttttctagctataaaacaatacacgcttgacaatatggaagaaatacaggaaataattttgtcaaattttgttaaagccaagaatgggaaatggggcggtaaaggccatatgtatgctagattcatatagtagtttctgttcttgatgttgagatcaataaacatctgagcaccttctatgtttccatcacagtggtaaaatactggggctaatgaatatgatgcaagtccttaactccttaaagacttatgtactttggacaaccattctatcccattcatcctaagtgaccacaatgattactaagagcagcagccgtgctcataggtgatggtggccaaaggctgacattcggaacattacaatgggctaatattctactctctcacaagggctgtctcttgtatggacgatatgatggcagaagggatgcaatgtggaaaaatcctaagtagaaaaattttacttctgtttgttttttaaaaaagtattcccctgacagcttggtctgattgacagctcttacatactgacctaatgaaccttcagcctgggagccttcacacattccctgataagcagtgaactcaagttttactgtaggcatcatctcctaagccccagtgatctgaataaactggcatggcctccaaataccactgcaaacatttattgcaggccaatcccagcaggaacgttgtcaaactgatttttcagcttttacagtctctctgcaaatcagcccaaatcacattgttccaggtttagattaagcatctaattgtgtatccccatggtctctgctaggattttgcaaaggtgttaaattctggtatatgaaaacatcacagagccacaagtgtatatgcaaattatctgcttattcccctgtagagtgtgaaaaatattttaaagttttttaaaaaactgctgttcatcttatagctattttagttgtctgtttctttcttacccattagggccaatttgtaaatgtacaatagggaagatgagacaaaaggctggggcaggaatgattcaggatcatgattaacaccaaagaatatgtcctgtacaaagggaatccacaagtcacatttagaggattcttctacattgtttatcttaggtcttaaagtataattcctcaggaaaaatgcagaaaccaggatactagtctactacaaagaaggaagactttgtgcatttatttcaaatctttgaacaacaacaaaaaggaattagtctaactatgactagttttctagaaacaacagtgacttactttagaattaaatgagcatcacgggactgtaacgcatggaagctatagttaacattttgagcttctgaaaccacttttatgatggacttttcctatctcatattctcaaattaaataaaacatttgttgctctaaatttgggataaaagggtgtgttcatcagattatactacttacatagaatttgaatttagctttaaattgtctttcattcctcttagaaactagagtgatgaatctggactaatcttttgcaaaaagtaaccacagaaatgaagatattgtaatccacagaaaaagaaaaaatatacacaatacttttcacttcttacataaagcatatttaatcaaatgtctttgaatttgtcagcaatacatataaacatacctatacacatatattctctctcactctcaggctacaaagctaccaaaataaagatagactctaaatgccaacataaaaccaggcaaacacaaatggatttggtaaatctattttgctgaacttcaactacctcctctggggctttggtctgtacttgcagcattacttttgcataactatggtaaaacaacagcaagagcaacaacaaaaaccaagattaattaacttggctggttcaggggagatctgtggcaaggtgtttttcctctaaaagctctaaattcatctagtttccagtgtgtcctaagcatttcaatccaattttttcctatgtgagcataagaagagaagtatactgacatatttagatactgggtcacagtaggtgaaatagatgtgagatagaattctgttttttaatacttcagtaaagagtcccaccaaattgttttttaagtctcaaatgcctaactatagatttaactgggtatttgtatcttgtatacttttttaaatctttgattctgtacataatatgaatgattttttaaacaacctacatatgttggtaagatccgtgctcttcaaggtagttactttaggagctacagaattaaggaatgattctatcattggcaaaaaacatttgtgaagtccttctttgggatatctttacagtaggcctcacagccttttaaatagttttgatgacagcaagtctttgacttttaatagatttgttttacaaaacaaatatttcagagccaaatcaataagtaacctgggtaatactaaagtttggttaaacactagatgtaactgaagaaattatactgaatttcttctctagctcaaattcagggtactgcacaacattcatttggataaataaattctggctgggaccaagcgtggtggctcatgcttgtaatcccagcactttgggaggctgaggtgggtggatcacctgaggtcaggagttcgagaccagcctgaccaacatggtgaaaccccatatctactaaaaatacaaaattagccaggtgtgatggtgaatgcctgtaatcccagctacttgggaggctgaggcaggaaaatcgtttgaacccaggagttggaggttgcagtgagccgagattgcaccattgcaccccagcctgggcaacaagagcaaaacttcacctcaaaacaaacaaacaaacaaaattccggttggtttggtaacaaaggcaatataccatcatccctaggtatccatgaggaattggttacagaacttccttcagaaaccagaaaattagcagatgctcaagttccttatataagatggcatagtatttgcatatcacctatgtacatcctcccgtatacttaaaatcatctcttgacaacttaaaatacctaataaaatgttaatgctatgtaaaagttgttatactgtattgtttaggggacatgaaaaaagtctgtgcatgtttagtacagatgtcatttttaaaaatattttcgatatgcctttcattgaatccatgaatgtagaatctacggatatgaaaggacaattgtattcagtataatatagataaacgcataaacgtgtgtgtgtgtgtgtgtgtgggtgaattctaaagcaagacaggatagttcattttacaaattaggaaatggagggcctgaagctagtgtagtcctagtaaagtccctggtatacagtgaagtgcttaaaaaatatttatgtagccatggccgggcgcggtggctcatgcctgtaatcccagcactttgggaggccgaggagggtagatcacctgaggtcaggagttcgagaccagcctgaccaaaatggagaaaccctgtctctactaaaaatacaaaattagccaggcgtggtggtgcatgcctgtaattccagcacttgggaggctgaggcaggagaattgcttgaacccagaaggcagatgttgcagtgagccaagattgtgccattgcactccagcctgggcaacaacagcaaaactccgtctcaaaaacaaaacaaaacaacaacaacaaaaacatacatatatatatatttatgtagccaaaatgatgatctatggagaaatacacaatatgctttaaaattgtgttagagtgctaggattatgggtgtagcaaacatcagtctatttgccagcccttcccatacccttctcagagaatctgctctttcatcaagtgcctggaaaaggtgacagtcctatcaccatgtgatcttatctctgctctggctgattggccacagaatgaacacctgacttaagggaaacaaattcacaggctagctggatcagtcagattctgtcacaagaatctgaacttggagagacccatgtcacataaagataggcacttgaagtaagcaacatactgtatcatagttgtggcagtcatgttcaaacaaaggaaaccaatggcgcgatctgggctcactgcaagctccgcctcctgggttcatgccattctcctgcctcagcctcctgattagctgggactacaggtgtgtgccaccatgcccggctaattttttttttttttttttttttttttttttagtagagatggggtttcaccgtgttagccaggatggtctcgatctgaccttgtgatctgcccgcctcggcctcccaaagtgctgggattacaggcatgagccaccacccccggcctgagagcaacttatatttctaacttttccattttggttccagcctaagacactctgtggtctcactgttgtttcctatccttggatgtccacaaggttgcttatcacatccttaaataaataccccttcactcaagctaccttatgtagatttctgttccatacaaccaagcagtgcctatgacaatgtggcagtggacctgattcctccctttagtttgtcaataaaaaaaattagaaaaacaatttttaaactgttcatggaatggctgaatgcccagggagattaagtgattcacttcaagtcattcgcacagtgatgggtcaagcattagaaaccagatctcctaactcatcacagaccctggagttacataaccttggaaatgttacttaacctctccttgcctcagtttcccccactataaaagggaatatagtaatagtacttaacctaataggatttttgtgaggattaaatttgttattatataatacaaatagtagaggccgggagcataatcccagcatttgggaggctgaggtgggcagatcacctgaggtcaggagttcaagatcagcctggccaacatggtgaaaccctgtctctactaaaaatacaaaaattagccaggtgtggtagtgtgtgcctatagtcccagctacttggggggctgaggcaggagaatcgcttgaacccgggaggcagaggttgcagtgagccgagatcacctcattgcactccagcttggtgacagagtgagactcagtctcaaaaaaataataataaaaataaacaaataaataaaatggtaatagctgattgaatcagggaaggaccccgacctacaggggaaccatcctaggcttgtcaaagacttggggcctggtgcaaaaaaaaaaaaaaaaggattcagataacattcctgtcacaggaacatagaattgggacccaagaatctttgtcaggaggtagaaggagcagttagatgaggataagtgaagtctcgtttcaagcactagattaaaggcccatgaactcatgatgtgaaggaccacagagccaccttgaaaggagagcaaagatcccatttccagggctctaggtctaggtgtataatacatcctgccctgaattcccttgagcctctctgtatctgttcaatgaacacccagtttaaatagctttttgttccttgtaatcagaagacactcaatgaagtaaaatgcttattaatagtaccttaactttttgtacaaaattaaaagcaattacatacacaacagcatagaagggaggtcccagatgcttctcatttcaaactttttttttttttaagtgttctcacactctgttgcagcatggtcatcacaatactctcatttctctctttctgggtaaaaagtgctttatcaccatcttatcaccaggaactaaatggcacaggtcttaagaatgagtaattaatcattctatatccattgagcatcatcggattccttttgtttaacatgacagataatagcttaagcctacattcttccaattaaaatgtgaaaacgttctttacaaaggtcttctactcttacaaagctaaccaaactctagagcatattctataattagcaccctgaaaatattttttaaagcagcaaaacagcaacctgagcacaaaccaagactactgcaaattgtaaacaacttcagatgatttacagaaaaagaattcgacaaagcttccttaatgtcaggatataaacagttcttagtgctatttagttaaatgataattataaaacccattgaactgaatgagaatttggattgtcagacaaatgtttgtaaggggttaattaattcatatgaactacacagctcagctgaaaatgggctcattattctaaaccaccaactttgtctgcttcttgtattgtcctcctttctccatcagatttatcctgttgcacccccacccacagtaacgaatgttaggagatagaaatatttaaaaggatatgtgagctataggcattttgcaagagtacatcaggggtacaaagatgtctgctggaacactgaaatgggaagatcatttattagtgcaccatggttcataacatcccaaagggttcaatattttcattacgcacataaacataacccctcctccttttcaaatgcctcattacagctaagcctggagcttttttcttaaaaagctttcctctgaaattattaataatttgaagttccctacaggccaagggtattattacagtcaaaatacctcaatatgtatatatacttatatactctcttttatgctattttaaataacaaagtatttagtggaaacaagtaaagaatttataagctatatacagaaaagcctagaggaagatggcaatatcccagactccaaggaaacggctcttgaagcttattaggtgggtgtaggagactgtaataggattatgagttttggtttagcctgtccatcatttcaaaatccccataactaaagggaatatcttcataggggtctgagtttaatattgaagctgctttatctaattcttcctattttataatgctgagtgctaattagttccatccactttcttcaggcttgtcaataaggcaacttggaagccaagaacctgctgaattatggattaaccagttctgtaacagcgtgttcaagcaacctagttagctactccaaaatgtaatgttattatgggcacgggaaagcataaaatactcttttgttatgttctgtttaaaagaaaaaaaataactccctacaagtgaactgtttatttctgatgtgttaatgaacattttagatatgtaaaactaaaataacatttactcttgtgtgtgtcaaacatagcctattaaattcacaatagccataatgatatttgctacaaaaaaaaaaaaaagacaaactagtcttagaattttgagtgcagaaaagaaaaatcttaaaggcagaaagactgagagactgacacgagttccctcatctaccttcacttttattgaacctgcatcccaacctccctgggccttcccattactttcttaactcttgccatttcaattgactcctttctggtgcagctagatgctagaatcggccctgtagggtcatacattctggaattagaagtaatgttagagataaactgatgtagctctcttatttcacaagtgaattaactgagatccaaaggtcaagcgaactattcgaggtcatacaagctagttgatatactaaagttaaaaaatgaatccaagtctcctgattccttgttccacgctccttcacttctacttaccatcataaccatcccattcaaccatgtctgaacttgttgctgtcactaggctgctgagctatcccctccaccaggcataattttttttagccacaaggaattcagccatgatcaagcattgacaaaacacaacttggctatgtctagtgcgtgctctgtggtttgactccccaagtgtccccagacctcccctgcctccacaggcttccaattctaccttcctttcttcatttctaaaggattagcttgatttctaccttgtaaaaatgaatctatctcccaggagtttaatcatctgccttcgcctagaaatcaactgttttctattctgctcatctttgtggcgagacaactctccttttctctcctcctgaagatttatttatttattaaggcatttattgaaatacatgtattcccttccttattggcaacttcagtctctccttttttactgctgctttttctttaaactctaactaataaaaataataatagcagtaataataacgagctagtacatacaaagtatttattattgagacagtcaggtgggagggggtccctggagaaactccaaacagcctgcccactaaggtggagcctcgttaagtttacactggggaggagcctggcccctccttttcctgtgtggaagttgggattctaacatcctgctctagcaggatgtttcccccttttcttccttttcaccaaataaaaccctgcttgttcaccattcaaattgtctgcgggcctgaatttttgtggctgtgggacaaagaactctgtctttagctgaactaaggaagagttctgcaacattttgtgctagggaccattttaggtgcttagaaagtattaactcatttaatcctcataataacccatgaggtaggtataactattatcctcattttacagataaggaaactgatacataggttaaataacttgcccaagatacacaactaggaagtggtagtgccaggatttgaacccagagagcttagcttcagattctgtgctcttaaccatcatgctgcctctttaatatatgtcatatctacaccatcacttatgagctctattacactgagcaagttacttctcagagactcagtttgttgatacgtaaaattaaaataatattgctaattttgtaggattgatatgaggattatgtgaactgcagaatatacataacccatcatgcctggcatatataaacatccaataaatgacaatgttatcatgatgagattagtaaccaccacatttggcttttatcaataaaacgttccaaggaagtgctcccagagggagataactctattatgtatttaagaaatccttacaaaaccctgttctaaacacaatgttaactcatatagttctcaaaacacccacgaggaaaatcctactatcatttccattttacatgtgagaatactgaggcagaaaggtaattcactgccccaaggtcacaaagctagtaagtggcagagccaagatttagacccacacagtctaactccatagtgtttgctataactatagcactaagcgagactctcaactctccttaacccaatggactaagacaagcatctttacaacatggcagctggcttgagagtaaacttgagacacccatggcctgtgagaatagcatagatgcatatagccacagtaagtttaaaaaggtgttttctagtgtagtgttccccaaacttgtcagctgaagaggagtatctagagattaaaagaaaaaacaaaaacagaatccttggccccctcccatacctaagtcagactctgggaatggagattggtagaagttaatagaggaccaaattagaatcacataggaagcgttttcaagatccccatgaccagcacctatccctggagactctgcttcagcatacccatgttggttcccagacctcacttgttacctttagaggattctagagagacaacaacttactgacaaaaagagagaagtacttctcatcccttcattatatgaaatgtaccttcatgtaatcaaatagttgatgagggggcattttttttatgaagtaatcaaactaattaaaggaggaataatagaatagtactcttttgaactaatggagctagagaatcatcagtggctgctaatataacaaaaagagtaaactagccatcatgtgctccaatataaaacctcacaacaccaacaaaaaaaggacatcttgacaaaaagacaaaacctgaatctgatcaagctttagagtggcttggtttatctaactataaatttacagaaaatatatggagtagggggacaggcaaagaaacaggtaaataacacagtgggatgcaatgaacaaaatataaactcaatcagacaaatgacctggttgcttcaacaataaaaactgggctgggcatggtggctcacatctgtaatcctaacactttgggaggtcaaggtgagagaatcgcttgagctcaagattttgagaaaaaaaaaaaaaaagaacgaaagaaaagaaagaaaaagaaaatggaaaaaaaacccctgaaaattacaagaaaaaaaggagagatagatgaaaaggtggagcagtcagcctccaagatgaatccccccaattatcccaaccccttggtattcatactctggtgtaattccctcccacattgtttctgggttggtttgtgtgattggcagaatatgacagaagtattgttatatcacttccaagactaggatacagaatgcactgtggtttcctctttgctttctctcttagatcactcactcttggggaagccagatgccatgttgtaaagatgcttgtcttagtccatttgggctactataacaacatacccagtggtatttattgctcacagttctgggggctgggacgtctaatatcaaggcaccagtaaatttggtatctgataagggctcgttccctgtttcacagaggtaccttctaggtgtcttcacatggctgaaggagcaaacatgctcccttgagcctcttttataagggtaatcactttccaaaggcctcaccatttaatactatcacattgggattatgtttcaacatatgtattttggggggacaaaacattcagaccatagcaacagtcaagaagctctatagagaggcccgtatagtgaagaactgatcttggagtagatcctctagcctcagacccagagacaaccatagcccggtccaatatcttgactgcaatctcatgagagacactgaaacgatcactcagctaagctgctcccaaattcttgacccacagaaactatgaaataataaacatttgtagttttaagcttctacgttttaaaggtaacttgttatgcagcaattgatgaataattgataattaacacaagggggattccattgttaaaaagagacttaacagaaccataataatgaatcaactttgtttggtttccaattcatactaaccaaaaagagtagataattggctgggcgtggtggctcacgcctgtaattccagcactttgggagaggggtggatcacttgagctcaggagttggagaacagcctggccaacatggtgaaaccccgtctctactaaaaacacaataattagccaggcatggtggcgggtgcctgtaatcccagctactcgggaggctttggcaggaggattgcttgaacccaggaggcagaggttacagtgagccgagatagtgccactgcactccagcctgagtgacagagcaagactccatctcaaaaacaaaaaacaaaaaaacaaaacaaaacaaaaaaaccaaagcagataatcagggaaatgtaaacactaaatagatatttgttattaaggattttttttcttagtaagatatgataatagtatttggttacgttagaaatagtcttcatcttttgtggatgcttacagaaacgttcacagatgaaaaaaacataatgtctgagagctgtttcaaaatatccaagagtagcagtatggagaaaacaaaattgatcatgaattgatcattgtggaagctgggttcatgagttttttttatattattgtattttgtatatacttgaaaatttcaaaataaagagtgaataagtaaagagacaacaaatcattgactgactattgaggttccacatcagatgaagcaattccaaccaagccacacaattaggagaggcacagtcccaatagccaaatagagctcatcaatgggtattagtgcctgcaaattcatacatggtacacaaatattgttatatacatatcttatctcttacttctttggtgtgtccatgtcttttctccccagctagacataggatagtaacttagggacatactctgtttatttattgtttggtttatcactgaagattgcctttttttttttttctgagacggagtcttgctctgtcgcccaggctggagtgcagcggcgcgatctcggctcactgcaagctccgcctcccaggttcacgccactctcctgcctcagccttgcgagtagctgggactacaggcgcccgccaccacgcccggctaattttttgtattttttagtagagacggggtttcaccgtgttagccagatggtctcgatctcctgacctcgtgatccgcccgcctcggcctcccaaagtgctgggattacaggcgtgagccaccgcgcccggcctgaggattgcttttaagttcaaggaggacatgagcatttctgtagaaagaagtcaatttaaagaaagacattaagaaggaaagaagcatgattctgaaggaggtaagaggaatgagattaggagcacaaagtttgcctcgggaagtgacactgagggaaatgaagggaacttgaaaaagatggtcatttactaaaactgtcaggtgcaagtttcagtttgagggactacagagaatagagaaaatctggaagaatagcagaggcatatgattcagtaaacaatgaacaaggagactgctaaggagtgatgaagatgcaactaaagctacaaacatacttcaaacatatacaataaaggtaatatttaagattcttccccacgggcagtgaatttatttttactatatttggttttgttgttgtattatttgattattacatgtaagaggagaggaatgagtaacaacaactgtgcttcaattgtaatactaccaacagggagatattctaaatacattattctttatggtgtatatgttttcacaggaaacttccccaatagcttgaataatttatgatttgattttaatattttgcaatcgtttggaaatatgtaaatagtctcttatttagtgaaagtctgaaaaaagcaagggtcaacgaacaaaggcaacatcaaacggtagaaacatcacatttgaggaaaaaagatatattttaacatataactgggccatttacaaaagaataatcagataaatatttgtttccatgcccatctgagaataatgcctcaacaaatagctatggacacttagaacaggaagcttagatataataatattgcataatttaataggacaaatagctgttgagtaatttcattttaaaatagaaaagctaaaataggatctcagctatccagaaacctcacacagtgagttgatctggatagcagagagtctatacgtcctaaatagcaacaatttttatcttagccattttgtatagaaatattttgaagatatattgtacactttgctgcctccgtaaggacaatctattgaaaatacatttttgctaattcgcataattatcatgaacatcaaatactgtgctgtgctgtacctacaaggtctgtagggcatatttgaggtgtgtctatttgtttcttctctaaatagaccaaaactgttctatgctcaaagatctttttcatttacaaatttaattttaatttttttttttttttgagacgaagtctcactctgtcaccaggctggagtgcagtggtgcaatcttggctcactgcaacctccgcctctcaggttcaagcgattctcctgcctcagcctcccgagtacctgggactacaggcgtgcaccaccacacccggctaattttttttatttttagtagagatggaatttcaccatgttggccaggatagtctcgatctcatgacctcgtgatccgcctgcttaggcctcccaaagtgctgggattacaggcgtgagtcaccgcacccagccaattattattttatttattctaatgatataatcagcagagagtcactgaagaatattgtaaaaaatgtgaaggaagtacaaatcactcatataccatggtatagccacaaagactattaatattttggtgtatttcactccaattttttaattagcagctgcgtatatatatacctatttcttttttttacatagttgagaccaattatacagtctgtattctgctttttgttttttaagatattatctgctttgataattatttcatctcttccactatagtcaagatattaactatcacgtcttagtgcttccagtgagtcttaaagtatctgtctacctctcaatcctggtatgtatgctgtttcccatttgctggacggtgaaaaaaatagaaaatccaatttgatagaactatgtctaacataataaatagattttgagtaaggtacttggaagactctcttttgataaaagtctacatgctgctttttaaggacttgatcacattcctttcgcctgttgagggatatttttgtttttgcttactttcaggtttactgccatattttgaagagatagatagcatttccaggtaggtacagttgctggaagagtggactttcagagaggtgaagtgttcctgtgctgcaatgttacagaataccataaatctgatgcatgagcctgacctagcagctttctaatacacacctacacagatataaaagttccctcgtttaaatttatttctgctgaataagcagcaataatctgtgttatctctcttcggaagatctaattacttacttatctgtgttcccaagccaccatgtacttgcttcaatattatccttatcatcctatattattttaaattgaatcacatgaaataaatattttcataggtcaaacaacaacgtcatatggctcaacctaacagtttaatttattgtgtttctcttttcatactagacagtatattcctttggggtaaggtccatctttgtaccatcaggctttggctataataaatattaaaatatttgttcaaagaatgtaaatatagtatattcaaatcagtgattacagattttatgcactgacttgacccaagttaatcatgctttgcatctagtaagtagtaaaaaatcctcatgtcatttactttctgaatctcttctagggaaaagctgtactgattttctacatatagtatatgtactatatgtagaaagatgtttacaacagcattatttatggtagcaaaaaaaaagaaacaaattcaatttctaatttaagggatggatggagtgaatatcatacattcttacgttcaaataatatacaaccatttaaaaggagacttatcaagatattcattaatgtaaaaatgcttataaatttaggtggaaaagtagtatatacaactttgtatacagtataatatgaacaatgtaaaatatgcatagaaatacaagatagaagaaaaaaacaaaatgtaaaggtggttgcttctggatgttgagactatgcattttcctttgtctttatattttacacattcccacattttctacaatgaacatacattacctttaataatggaaaacattttaaaagagaaaaatatatgatggcagtacacttcaaagaagttggccaagaaaagaaggaagacaagagggatatgtaattgataaaacagagcatttatttggaaaagttatttattcattctagaaatctttactgacgacatattatgtgccagggacataaacaatcttagccatgacttttcacgtgggtgactcagaacacttcagaagcctacgtccattgtattttgtgttttaacttttagaaaatggaactaaacaaaatcattttagtcagataattctggaatactagaaaaggggcactgaccaatttgtaattctataagtgtatctcttcatgtggtacaattccttttcacagtcatgttggtcaccatcaaaatccaatgtaaaaagagaacaagaacctctagcacttgagaataagaatctacccacagtcatttctaaggatggtcaaactctagatgacctcagcaggaagtcctagtatcactttttacagaatgctaaatttgtcatttgaagataaaccctagacactgatagcttctgttcataagtttcatgaaagcaaatgaaacactaaaatattaatgttatatttctgcctctaatagagctatgatggctgtggccccctctaatcacaagacttaaaaatacatttgtctctagtaatgaacacttcaatcagaaaaacaagatgaaatctttatagagatactataggatgtatgcacaagttgtatttcttagacacatatttgactatattcgtttctttttttaagagatattatttttgcagtccatttctaactaaaacatctgaagcttcaatctatccaagcaaaatattggtgttatatatttaaatatttttcctagattgaaaaataatgagataaaaaaacaactgaactgctagagttgcttgtccttgatccaaaataattttcctttcaaaaattttactacaatagcatagcttacctaggaaaataaaacattttccacagtatagatgtagtcataaaaaaagaagtctaaagttgaactatgaaggccaggttacaggcaatatttctattgctttgtaaacgtgtaataacagaagcagtaggttttcttataattatttggaacatggagtatggggaaaggcacactttaaaataaggtttgttctaattgttccatttagaaaatatcagacttattctatattgatagtgtctaacaggcaatgcaactgtaagttcaatatactatatttactgctatgagttaagcaccccataaatcattgcttacattttaattgttcattattttaatcaattatataatagaaataaatgaaaccaataacattgcacttattttcataataacatcaaaataatcatcatacaacttaaattcggcatcatgtcttctaatgtcaaaatcctgcttaattttaccaaaaagacttatttgagagatgaatactagaagatatctgcaccaaaacaatgcttccctttctaatataacaacagtcttgtggttcaaatgtaatggatatcacattttctcacagcgttggactgttggagatgcggcaggtaatgtacatacatgtcagatcacacagagccttttgagctactgtaaaaaatttaaatttctcctagaagaaatgggaagatactgaagggtttaagtggcattgatttaacatagtattgataataatctttaaacactttaaagctctattcaaattttaaataaatacactttaaaagtttcaaagaagtttcacattcaccatctcactttatcttcttagccactgtaggaaataagcagggtgtcttcattgtgattaacttaaggattaactttttaaagtgtggaaaagatcctatcagtatgaagatttcctgaagtttcaacgtcaaaacttgctcttttttgggtggtttgggaggattagcaatgaaagattttctagaagttttcacttcttaaaaattacaaatcttcccttcttcctttaaaaaaaaaaaaaaaagtagcccattgtataggaggcttatcctgtgacttaaagctgtcattcaaaatggacagtacatcttaatgaagggtgctaattgcattaatattctgggctaccacagaaaagcatagcatgtaggtatgttaataaaagataaaggccataattatagcacttcagtaaattgtgggacataagggctcccagattcacctcagaaatgaaaagagaaagaaaagagtctatgcaattgaaggactcagggcaaaagttatacagaggtgggggctgcgggatgagaaagtctcagaccgaaaacagcctgagcagacaatgggaaaaaatactagagtggcaactagtgctcttaccaaacaccaaaggagctacatacgtgtacacataatatagctccttttaccatgtcagattttctaagaggcttttataattaaaatacattcaccgcctccctatactttaaaagaaactaaccaagcttatgattctaaagctatttattcaaggatgttgtaggttaaagattgtatacatagtaatttatggcatgtagaataccccttacattcgaaccactgtaaaaactgagctacataacatgattttataatatcttctaggatttttacctcttgatacccatgcctaacttccattaacattaaagtgcagatttatatgtgctcacagctggtggatatatctaaattttattaaaataaaagggaccaatagccactatttatttccaggcaatgtagaatttgaagaatcgcataaaagtctttttattttaagagcctaatgtttatttactacccttcatctagatgctacagcactcaagaaacttgaactgatattcacacaatacataacaatcgcttgatccacttaaaaaaaaaaaaggcagctgcttcttaggcttaaccatgctatataatgcagaggacagtaaatgataaataccatagccaattgaaattgcataagcaattttagtgagtagaatgtaagacatacagcattattcaatgctgagtattttcataagcaatggtgagaagtgctaacccacggcacaatgggacccactaaagggcaccatggtgggactcattcagccactggttccccccactctttgtccctttggctgcagctctcactccttgcttgtcgtctgagtggagatttagtcagatgaaattccctgggattataataggaattgttttgttaaaagccgggtaaccaattgaaaatactaccttcctccaccccttcccaacaatcttccctttgaatgaccatcggtagtttcacaaaatataatacatctatattgcataaagtcgtttacctgctagttaaccagaaagtattatttagtttcattactttaatacaaaaatcataaaacaaaaggcatttgtaataaaaacagattatgcaacaaatacctgttttcaaattgccttgggactgtttatggagtggtgtggcctaaagcaattactaacaccagatttgaatgctattataaataggcataggctttccttagataacctgtacttatatttatcaataaaagctgagacttaaagcttgtagtaataactttgtggggaaagcagagaaaacttattatctgtgatcccttctttatctctccctattacatctgggacaactctgtagtacttaggtgatatgactaaatcttattagtagagggcttttctattttaagcacaaatctggcattaaaaagtcccaaagtaaaaaattaacatagcaaatgtcaggaaattaagcaaattaaaagatactgtcaatagcatgcagcactgtcaaaggactaataactccagttaaatactatcaggaatgggtagtagatttttgaaagcagatacgaaagcaagagagacatttaatgtcaaagcataaaagatatttagaacacaatagctattatattaagccatcagtcctttgattattattttatcattggtacagttaacatagacgggtacaaatagcagtaaaaatctgtgagattttcaaattatcagcttgccccagtgctaatcatgaattataactagtgctggcattagtaagattcacttccaacttaatgtgtttatatgttttaaaactagcttattcaggaaaatataaaccacaaaaattgttaatgatatacaatcttttcaaagtaggcttatttccttttatttcaaaactttatttctctttccataaaggtgaggttaccatgacagtattcacagagcccctgctttggggtgcttttccaaaaggagggtttgatttgtaattattcatttatattcttgctcagtctctattaacgcttaagtggcaggtagtcggtaatataaattactcatgtgagttctgtttcaattagctattaagagtcataagtgtgggaaaaaataatttttagtttcatgttaggttagaaagaaaaacatttataccataacaaaatattaattccctgttttcctgttacaaaatcttgacattattaaaggagttagaagagtagaacaatttggaatatatattgaatttctgactttaataatgaagatgtggttctgtgtaatctaaaattaatttaaagctagttaagtagaatattctactatgtctgttttgttctctccacttgttcaaatttaacaagtggtagtagcttttaggacaacaagcacaaaagattcaaattagatgtcaaaattgaataagttaaatctgccttcttttattatttgaaaaggatttagctaattttctcaactaatatttttagaaaattattttgtctcaataaaacttacagctctgtaaaataaacttcaaaagcagtgactatttcttaaatagcgtgatatttaaattgaaaacaaataaaatgacaagtgaaatgggataagaaagaagaaccatctaacaggcatgctttggaggggaagaaataaacaagggagggagcctcaacaaagccctgccattctctgccccacacgcaagtcaaattaaaaaaccttttcatttggccacattgtagtcctataacccaaactaccgtaaaaaatgtaacggtggtttgtttttattttaaccgtgctttcaacattttacagcctgtggaggattttccctgttacatacagagctaacgcaccacccaccatctctagaggtgaggttaccatgacagtacccacacagccccctgctttgggttgcttttccaataggagggtttgatttataattattcatttatactcttgcccggtctccattattactatgagctgcatagtgaaccaatgtgaaataagttgacaaagaagcaataggcttttaaaaccctgactaaggcattcacatcattgagaaaaagaaaatctccgagacctagcccaggaataaaagaactcagatctaccttaaagctggaacttccctgctgagagaaacaggaagaaatgatagcccgtaataccactgcagctgcaatatttctgaagtaggacactcagaaaagggcacaagctattaatgtttctagaaacattacatttaattcctcagcgaaagatttagcagcttagtggaaagaagcagcagacggaagaaaaaaaaaagaaaaagaaaaccagaaaccatgaaagaatagtcagctctgcaaggaaatttgcttaaactaatattagaaagaaaatatttcagaaattgttgcccctagtaatcttacaccccaaggctagaagaaaaggtcatagctaattggtgcaaaagcagctttggagacagaggaagagatactctgtgatgaattccacctaaccactaccctttttaccttcaattatgccaggacatgtaccacatattatagggcccagaaaagaagccatacttcgaaattgagcttctttcatagttttttttttttttttgcaacatttaacttttataacccacccaattaggagaacaaaacctctttaattgtcaagaatgggagttaagtagtagtttgaagttatgcataattaaaatgatttgcatgatttggtttaaaaaaaccacacacaatcaatcaaatatactattttcctggggccatacttcagtttaggtaaacagataaacacatgcactacagagtcctacttttattggagcaagcctccaagtttaaaaaacaaaacaaaacaaaaacacgtggatgaacataggtgtatattttcaaaatattagagaaaaacattaacatatcaattaggttataaggaaagtgctttaaattatttttttctttgttttacatgccttaataataaagaactccccctagagtagaatttaagtatgacctgttttagtaagaactattttgactgaatttggagagacaaaaataaaaaatgctaaacctaccaacctgttctacatattgaaatacagaattttttccttttcattaaacacattcacacttgtcaaatgtaaataaatatgcactgtagtttgaggaacttttatgaaaagatattttttccttttaaagtttttttaagagtgtagacttttttgagagcaaaataattatgtagtcattttgcaattgtgtatactaattgatgaaatcattaatatagaaatacaaaaggttaattatctacttgatgccttactcactatcacaaacacttgtaaattccagtggtgatgaggtcataattccaaaaaggctggcaaccaagaatttcatccaggaatttttatctatcccttttaaacgcttcttcccccacccccaccaagattagaacaattttacataaattaagagagggtttatttggagtaatgtgtatcgtcgctcttggttttttttcccccccataaaccagacagaatgctgagacttaagacagataaaagacttgaaacaatgcttagacacctatattttcctgatttttccccccagtttttcttacccacaactaatgtgtagaatagcaggttggggcaatggaggtgaaaaccagtgttgtgaggggctgggtgtggtggctcacgcctgtaatcccagcactttgggaggccgaggcgggcagatcacctgaggtcaggagtttgaaactatcctggccaacagggtgaaactccatctctactaaaaatacaaaaaaaaaaaaacaacaaaaaacaataagaaaaattagctgggcatggtggcgggcacctgtaatcccagctactcaggagactgtgacacgagaatctcttgaatcctggggacagaggttgcagtgagccaagatcgcaccactgcactctgttgcctgggcaacagagcgagactccttctcaaaaaagaaaaagaaaaaagaaacagtgttacgagggagataaacagataaaacaaaattcttctgaatcaggagaacaaagtgaggaaagtagtgcgcaaaaagcctcaggaccataaagtacgggaagcaggaaaaaagtgaaaaagggataatctataatgcttacaatctgtgtggacagcattcaacttgcccataatattttctcagtgctttgcatcttcctctgccaggaagtttcagttctaaataagccatgcaaactgatcaatactgtttatggcaacaaaaaaacattatttcaattgttagatgtgacatttttcttcccatttgtccttcccaacctgtatcctatggaaattcaacatttaaaagattctctaataatttcctagaaacacatgatgttggaacttcatttctaaatttattttctaataatttctaataattactcactaatttattatacccagtcactaaggataggcatcatctgggtgcttccacgttctgggtttttaggactactaactgagcttattataatgttcttccaggtgcaaaagagtttgtttaaatttggaccataaagtaaaatctatgtactagaaaagtactttttaaagtcctttttcttttcaattcatgattgtttatggttgatgatatgacaatagaattaaatccacaaatattatgtacaaagcgctgtcatttctcattatctcttccacataaggtagtactgatatagacaactgagatgatgtcacaaacataattaaaataaacactggattatccacagaaaatcatattgcttacccctcctgatacaaacattccttcatagtttagctccaagtatttggagataatctatcggtttattatgaaaaaagataaacatgtacacttttgattaataactataaggctgctaaagctcgaacaggtattataactgaaataaaaatgaaatccatgcacaatagcattaactttccaaagaactatatgaaaatcatacccttgtttttgtttttcatttctttgtgtccaggatatacactgactttctgaaaccactgcagatttgtgaataatgtatgaaattaaaaaaaaaaaattcctgttcattgcccagagagtattgtattgcttgtggtatactgtatctatgctagacaaacaatagaacagaccagtaaacctaaaatctgaagctaaaaccttcccaagtggaaagggaaaataccatcctggattccagaagtccctcaaacaaacagatcaaatccttataacagtcttacatactattacgtagaactgaataaaacccttaaacgagaaagatctattcttctgagcaaataagtgtgacagttggaaaagcaattatttacttactgatattctaaagaaattcactaacttctatttccccatcttatagagcatcacagtatttgcaaagactgacgagaacatatgtaaagctgaaacaaaagggtattattgtcactctattcttattttctctggcagtatttaggaatttgccctctaagtagccatgtgggagtggaacaaaccatgatttgagttgagaatgacataggggtagcagtcaaatgcaaacacaatgaatgtaagaataagaataatggcatacagttacattgtgttttttatataaagtcggcatttttctttacttgtcaagcataaacattactgagtagaaaggtcacgtgaaggtaacatacataggacatgcgagcttgctcataaaaactcagctttaatgggatttcatttacagtgatgtagaatacaatttctatttcctccatccctcaaatttcaaacttcagagacagctttaggtataatatattaaacaggcttttgtgtagattcaatctttttaaaataattgtgaagtattcaacaagcaggtatcaaaagcatatgctatgagttatgtgctagatgctaaaaataaatcacaatcttttaacagcagaatatagttataagcatagtatttttatactttgtatcatctatcaatatatctttaagagagttgactttgagcataactttaaaaggcttcccggaataggtgaggcactatcttagattcaaggtattttgcaaatgcaaaagataccaagaaataatagaagaactgaaatctcaaaagggttctgtgggctgagtgcagtggatcacgcttgtaatcttagcactctgagaggccgaggcaaaggaactgcttaagcccaggagttcgagaccagcatgggcaacatagtgagactctgtctacaaaaaaatttaaaattagccaggcacagtgctgtgagcctatagttccagctactcgggaggctgggggtggggttgaggggctgtgggggagaatcccttgagcccatgagagtcaaggctgcaaagagccatgatcatgccattgtgctccagcctgggtgacagagggtgaccctacctcaaaacaaacaatcacaacaacaacaaaacccaaaacaaaacaactgtggcgcttaagatacctactgctttcttccttccttctttcagcttccactcctctcattttaatgggcaacaagaaaaggaactaccaggagtaaggttcaaattttaatacacagaagaggtgtatctaaaggtttaatgaaaattgaagggtcagaagtacattcatgtccaggtaaatctggttgtcttgggatgtccactgggaaagcagatggattctgctgtaaagcaagcagagcttaaaatttcttatccctatttaggaaaatacttaataatatagaaatgagcctgtatgagagaaactttcccataatcaaggccaccaattagaataaatgtttattttcctttagttgtaaaagcacttaattttctagaaattttaaggtacttatgacaacctgttgagtatctttttgttttttgtagttgcaaatgcacagagcgtctgctcctgttagactggcatcatgcacttgccatataagatcccaatcatttattcctgaattgcaagtttgtaaataagcaggtagttgtgtgagcttagctaccaacattagcatgtctgaatttttgacatgaacttaaaacaaccaagataaatttattgctgcataattgtttgtcctaacttatcacatattccaataactaaagaaagcctgctataatcatattctcataaaagtcaactagaattgaccttatctcctattttcctgcagggatcaccaatgaggaaatgtgcagcagagctgataatattgtgtaggagaacagacaaggaagtgagtgattgaaatttctatagagaacatcatcaatacttacttagaacaattttgcatataaataggggataaatggtccatgctcaatttgttctctaattgtcaaggaatgatcaaggatagactacatagcaatcttcagtttctagcttccttaatgcaaagctagatcttattagccaatacatgtgatgtctgtcccaaaagtaaattttattttattttatttatttatttttttgagacggagtctcgctctgtcgccaggctggagtgcagtggcacgatctcggctcactgcaacctctgacttcctggttcaagccattctcctgcctcagcctccagtagctgggattacaggcatgtgccaccacgcccggctaatttttgtatttttagtagagacagggtttcaccatataggccaggatggtctcgatctcctgacctcgtgatccgcctgcctcagcctccgaaagtgctgggattacaggcgtgagccactgcgcctggccccaaaagtaaaatttaattttcatttaaaaataaaaagaaaatggaaacaaacaaaaattacatagccaatacaggtacacacttcatcagaagattcatatgaagtgatgaaaaaaagacactaaattaagtggtctctaatagcacttgagaactcaatgcaatctgacttctactccttttttttttagacagaggttcaagcgattctcctgcctcagcctcccgagtagctgggattacaggcatgcaccaccatgcccggctaattttgtatttttagtagagacggggtttctccatgttggtcaggctggtctcgaactcccgacctcaggtgatctgtcggcctcagcctcccaaagtgctaggattataggcgtgagccactgcgcccagcctacttctacccctttcttatcgcctccctccaaacagattctcctgaaactcttttggctaaggtcaccaatgaatttctattagtgaaatccagtggatcctttccaatccttattttagtcatcctctcaggtacatgtttataaatttgtataaatttaaggggtacaagggcagttttgttacatggatatatcctgtagtggtgaagtctgagcttttattgtaaccaccatccaaataatgtacattgtacccattaagtaatttctcatctctcacccccctcctacccttacatcctatttgagtctcccatgtctattattccacactctatgtcatttgagtctcccatgtctattattccacactctatgtccatgtaatctctgctatatttgatgttattaagctctttctctttgaaaagctctactcctttggcccctgtgataccacaatagctttcttctccccatatctccataatcaataccttcacactctctctttctttttttttttttttttttttgtgagacgaagtcttactcttgtcccccaggctggagtgcaatggtgcaatctcggctcactgcaacctccacctcccgggttcaagcgattctcctgcttcagcctcccgagtggctgggattacaggtgtctgccaccacactcagctaatttttgtatttttagtagagacggggtttcaccatgttggccaggctggtctcgaactcctgacctcaggtgatctgcctgccttggcctcccaaagtgctgggattacaggcatgagcaactgcgcctggcccatgctgtctttcataggctccaaattccgagctagtcccataaattggtggttctcaactttggaagcacattaaaattggctaaataatttttgaacatgctatcatctgtgctccaatcctatagatttcaatttgattgcttcagagaggaactggacgtgggtatttcctagaagtacctcaaagtaataccagtgtgtggccagagctgagaatcactgccataaatgtttcttttctccagggttctgtcttaggatcactgctctactcattctccagagattatctgacccaccctcatgttattaactatcacctggatgtttatcatttctccgagactcctggactcatgctgctgagaaaactaagtggctagcataaggatatctgatttgcccctattcgaccacctgcttccctcccatcaagagaattacatatgtactaccacccacctgctcctgactttcaccctttgcaaaccagttaattctgaagttgacaaagattttcttaaggtggccccacccaccccccgcccctcttttattttgagacagagtctggctctgtcacctgggctggagtgcagtggcacgatcacagctcactgcagcctcaacctcctggactcaagtgattctcccaccacagcctcctgagtagctcggactacaggtgtgtaccaccacacctggctaattttcttttcttttctttttttttttttgagacggagtctcgccctgtcgctcaggctggagtgcaatggcacgatctcggctcactgcaacctctgcctcctgggttcaagcgattctcctgcctcagcccaagtagctgggattacaggcgcgtgccaccacgcccagctaatttttgtatttttagtagagatgtggtttcactatgttggccaggctggtctcgaactcctgaccttgtgatccccctgcctcggcctcccaaagtgctgggattacaggtgtgaaccaccgcaccccacccctggctaattttcaaataaaaatttttgtagagacaaggtcgccctgtgttgcctagggtggtcttgaactcctgggctcaagagatcctcctgccttggctctacaaagtgctgggattaaaggtgtgagccactgtgcccaactcctattcatttttggcaccttttccatcctaccctcttctaccctgttaactcaagaatatctctcctctaccctcaatccagtccctctttgtatgagccataaatgttcttcattttaacttatgagagtaaaactctacattggaggctatgaattacatatcacacaactacaaatcactaggcatgctaaggtagtttagctaaatcacacagtatatgctcaacaaatgcaactgaattaagcagggggcatcacatatttgaaagtaaaatttggcataattattagtgattgacaattccattcaagatctttggtgtgtctagcgtttcctgtcagaatctctaaaagagacacaatttatcttttcattgtcttctaactacttttctttccctcaaatctcagcattcaaggtataaaatatattcttcattatttaatgcattatatcctggctcttggtgtggcgtggtggcttatgcctgtaatcccagcaatttgataggctgaggcgggcagatggcttgggcccaaaagttcaagaccagcccgggcagcatgacaaaaccccatctctacaaaaaaaataaataaataagtaaaaatagctgggcgtggtggcatgcacctgtcatcccagttacacagaaggctgaggtgggaggatcatctgagcttgggagtttgaggctgcagggagtggtgatcgcaccactgcactacagcctgggtgacagagtcagaccctgtctcaaaaaaaaaaaaaaaaaaaaaaaacaaacaaacaaaaaaaaaaaacaagaagctgcctcttggccctcaaaattacattgaaagtacatgggaaaaggtcaggtgtaatctgctagttgaaaaacccattggtcaattatcagttgtcattctgcctagcttttctataggatgtgaccatgttgactaattctccattctgaaattctctctactcttggtcttccaggtactacttttttttttctttttttttttttttaaagagagggtctcactatgttgcccaggctggtctcaaattccagggctcaagtattcctcttgccagttgggattacaggcacgtgcctccatgcccagctcttaggtaccactttttactgcttctcttcttccctaatttttttttctttctgagtatcctttgttgatttctctatttacctcttaaatattataattcccaaatgtaccatcctcaaccctctcatttgagatgtcctttctgggtgatcccaaggtttcaataaacatatatatgtgcagatgtccccaaaatctgtctccagcctcaaactcatttacgtgtgtgtgtgtgtgtgtgtgtgtgtgtgtgtgtaaaatcatgtaatcctttactttaaaccccctgctggctctttgctacaacaaactaacttttcatcattgccactttactccttcatatctccatcacatgtttttgtcatttcctttatctgaaaagcctattcctcttgttttcccccaaactactactcatccttccaaacatagatcaaaggccactttcatcatgaagcctctcttgaattctccaggcggttagttgctctttttagcactttttgaacacttatattatgaaatttatatcatatgtctttcccatgaggctctgagtttttaagggcaagacccatatttgtactccaaggccctagcactgctgcctggcccctagtatttgattaataagtattacttggatgaatgtcatgcttttatttatttccttgcattactttctaaaaccagattttaattgtatattacaatataatgaatgtattatagactaaatggggcttagtgtggtagtataagattctgacatttataaaacagagactgagaaagttcatgaagaagaacttatcttcagggagaaagaagtaaacagcttggaatgaacgaccagcaagacctagtaataataaaacaaaacaagcacaaaaccacaatagaccttggtcatcaagatgatgctgagtattacgtgggatctgttatgagcttgtctttggctcttgccatcttgggtcaaatcctctgtgatggtgggcgggggagggtgtcatttaaaattgaaagctctttctctaaaattatctgtaatagtctgaggcataagcagtactacttggtacacaggtggagtgccgcactaaaggaaaagagagaggcatttcccccctactttgtcaatgatgactgtcaaactctggcgttgtgaagccatgagtccctgctgctacagaagacagcaagcgtagaaatgcatgatattatagcagaggtggaggaacggtggtgtttgcttgtttctgtgaaatgccccctgataactcccagaaatgcttcatagatcccttatagcagatgaggtgctgaatgtgtatgtagagacaagagccagcaaaatttgagttttcttatttacatgaggcagtgaggcctggggaaatgtgggttttgttttgctgtgaaattattcttccctaatacatacggaggtttctttttctctgttgtataacattgtttcttgtcccctatctgttctcaaatggtaaattataccttctcatttatactgttatcttgctgacacataaaactaggatcatgtgtctcctgagttgctcctgatttttgaaatttagttttcttggttgccccgtgtggttctaaaaccaaaatacatttattgtttcctggtttcatttcttcataatgcttctcttgtgtgtttttttaatgtctagaactatatatcaaaatccagtcatagccaaaatgctaagttagatatccacctattgctgagaagcccatttatatttacttacagtgggcaaagaataaaaaagtcgggttggttgaagaaagagaagcaagctctaagtatctatagctatttggcaataaaacagatgtggagttgtgtatttgtattttaagagtggttttctggctgggcacggtggctcacgcctgtaatcccagcacttttggaggccaaggagggtggatcacgaggtcaggagattgagaccatcctggctaacacggtgaaaccccgcctctactaaaaatacaaaaattagccgggcgtggtggcaggccctgtagtcccagctacttgggaggctgaggcaagagaatggcatgaacccgagaggcggagcttgcagtgagccaagatcgcgccaccgcactccagcctgggcaacagagtgagagtccatctcaaaaaaaaaaaaaaggaaaaaaagaaaaaaaaaaagagtcattttcactcctgcaaggtgtctctctatgtgcttctttttcctccaaagcttatctttgatcttacaattacacagccagggcaattctttacaaagtagatggtaaatgtatgcaacttattatcttatgtggtaacaaaggctgtaacaacacaggatcaagaaagatttagcaaaattcagagaagataaatccatactaggttgtgaaggaaaaatgagatgtacctttcacccaccaaactgctagaaagaatagcccatattatacagacacaaaggagagaggtggggggttgggagtggttactctaactcctatgctgcacaggcttactgttcctatctctattacagcatatagaagaccgcattgtaaattgatcacatggtttatattcgtgttttcccaaacagtatgtgagctcctctaggctcccgtttgattttgtatcctcagtacctaactcagtataatgcaccgaggaggcattcaataagactgctcaactgttgaatgaatatgatctttccctatagcctcaccatctactctgcatagctctgtattctcttcccagttccatcacaatattgaaaggatgctcttcaaaaagtcattagaaagctcccaaatagcaaatcatcggttttttacccttttttattccaccagagcgtatgtcattgtcaaaaatgttcacctctcctcccttcttaggacttccctcttcctttgtttctaggacaataatgtctggattctcctacctgcccaattgctccttgtctatcttcttttagccccttagtgaaggtgtttccaagtctctgtctttggttttcttttctcttaaaaatccctataacaatcccttcccctatccacactatatccagaacactcaagaattcattttgtcatgaaatctgtaactatatttccaaaaatcttctggacatcttgacctcagtgttctgctatcactttcagtttaacttatccaaaactgaatttaccttcttctactatcaccactccttttcttgatcttaatagtttagtaaccttacggctgggtgcggtagctcacacctgtagtcccagcactttgggaggccaaggcgggcggatcatgaggtcaggagattgagaccatcctggccaatatgatgaaacctcgtctctactaaaaattaaaaaaaaattagctgggtgcggtggcgtgtgcctgtaatcccagctactcaggaggctgaggcatgagaattgcttgaacctgggaggcggaggttgcagtgagcggagatcgcaccactgcacttcagcctggggacagagtgagactccttctcaaaaaaaaaaaaaaaaaagtttagtaacccaaatgtcttcttagccagtcatactcaaagccatagggttatctttgcctcttgactactcctctcacgctaaattatctctaaataagaatatgacaatagactcctaattgattacttatactcctttaaatattctaatgcgtaacttgtgttcctccactgcttaaaagccttcaataaatccccattgcttagagaattgtaagttaacaccttagtctctcattcaagcactccctgatatggagcaaacctaattttccagaattacccctatacttctatgctatatatatcctattttcttactgtactgtttgccattgttgaaaaatgctttgaactttcttgcctctgtttttcttaatgacatttcttttgactaaaatgcccactatccctaactccagctctcactgttggaatccctactcatccttcagtcttttcctccattattatttttctgatatatctgataatgcatgcaagtcccattctctgaagtcacacagtatgttattaacacctcttgtatgatacttattatcttctgccttattctgtagtctttctgtgctttttatcgttcctataatacacagggtcttataactaaggaaatcttatcttaattatttctacatcttccctcatcatgtacagcatagtaccttttacacagcagatgtacaataaatgaatatttaggggctcatttcctaatctctgattttgacatcagcaaagcttgtgatctgggttaatattcagctagtatgcaccagtacaaccagagtcgttatttatcacctgtgtacatttcgactatctggggcctgtgatacaccagttaatattttctttttttctttttttgagtcagggtctggctctgtcatccaggctggagtgcagtggcacgatctctactcattgcaacgtctgcctaccgtgctcaagcaatcctctcacctcagccacctgagtagctgggactacaggcacatgccaccatgcttggctaatttttttttgtatttttttgtagagatggggttttgctatgttgtccaggctgtcctcaaactcctgagctcaaatgatcctctcacctcagcctcccaaagtgctgggattatagggatgagccaccacgcccagcctttttgttttttattaaaaaaaaatattttcaattatcactactgatatgatagtctaccttgaaatgccttttggtacttaactgaaacagcacatccgctgaatgggctggaggcaatatgtggaagctccttctgagttactaaatatggtaggtcttgggtagggggcacaggctcagagtgggcgatttataatttaggcaactaatcatatcatttattaacattttgattttctaatgaagaatacagactatcacctcatcttgtttacatataaaatttaaaacattacaattagatggccgggcacagtggctcacacctctactcccagcaatttgggaggcccaagtgggtagatcacctgaggtcaggagttcgagaccagcctgggcaatagggcaaaacacagtctctactaaaaatacaacaatttggccgggcatggtggctcacgcctgtaatcccagcactttgggaggccgaggtgggcggatcacctgaggtcaggagtttgaggccagcctggccaacctggcgaaataccatctctactaaaaatacaaaaactagctggacgtggtggcgggcacctgtagtcccagatactcgggaggctgagtcagcagaatcacttgaacctgggaggtagaggctgcagtgagccaagatcatgccactgtactgcagcctgggcaacagagcaagactctatctcaaaatataaaaataaaaataaaaataaaataaaaatacaacaattagctgggcatggtggtatgtccctgtaatcccagatactggagaggctgaggcacgagaatctcttgaacccaggaggtggaggttgcagtgggccgagatcgcaccactgtactccagcctgggcaacagggcaagagtccgtctcaaaaaaataataataaataaaaaataaataaaaagattacaattagaaacacaatggtagagctctgtattttacataacagtaatacccatctataagcgatggtaatgaaaatggcaagcagagcagtaagtacatctccgctgattgtggttgactctgattttagtgttttttggattttccttttattttactttacttgggggaagatagccttctttataattagccttttctgcttttatctcatcatgctgaagtggaggttgttggaaaagatcaagaatgtcaatgttgaacagggaaagtataacaataccaagtcaatgggatcttggaaaggaaacaaatcaggtgcctaagaaagtaaaaataacgggactagcaggaaaagatgatctagctaggaagggctgaggcaaggaggaaatctgtaaaagtccccggttctgcttcttccagaaagaggcagacagagttttttggcagacttgtaaactctgtgccttctgtccccactccctcacttccagctcttctactgatgaccaaggtgcttcccaaccactgccactgtctgcattcgagtttcgttttacctctggacatttgctttggctgctgccacttggaatgactgccacagctaaatcgagtgatatttttaaccctatgtgttcatggaggcactccagctacaaaccaaaggaaatcccaatttagattacttggaatcagtactataaaattatgcagtttgtgaatatattcttggtgtttcacagttgacaacactatattcccttgagtaccaaactcacagaaaccccatggaatgatctctctctccaagtacagtttttctggaatcagtatgaggtgtgagactaatcagacaagggctttagcaaatgtgcatttttaaaataaacagcctagaaaaattatggcagttcttttatggcccagaataacatgttttcacttatcagctgcttaacagagaaatgaattgatacaaaaatgatttcagttcacctttcactgacta

SEQ ID NO: 5762 - DNA, 116953 bp, human; identical to SEQ ID NO: 4773

SEQ ID NO: 5763 - DNA, 118629 bp, human; identical to SEQ ID NO: 4771

SEQ ID NO: 5764 - DNA, 118627 bp, human; identical to SEQ ID NO: 4772

SEQ ID NO: 5765 - DNA, 57010 bp, human; identical to SEQ ID NO: 4779

SEQ ID NO: 5766 - DNA, 57031 bp, human; identical to SEQ ID NO: 4778

SEQ ID NO: 5767 - DNA, 57031 bp, human; identical to SEQ ID NO: 4778

SEQ ID NO: 5768 - DNA, 57031 bp, human; identical to SEQ ID NO: 4778

SEQ ID NO: 5769 - DNA, 56214 bp, human; identical to SEQ ID NO: 4782

SEQ ID NO: 5770 - DNA, 47414 bp, human
agggtgagaagggccggctgccggagctgggttgcgatcttcccggagccggagaccctcccttgaaaccggcactgggacttctcgatctctggaggcacctgttgcaagtgacaggtaggtcaacagccagcggccggcccctcgccctcggtccggtgctccttctggacccccagctccttttcgctgctgaagcgcccccacccccatctcggggtcgtgcgtcttccctacccgctctctggtcccccaatttttccttctccctagctgaccgcgtctcccctctccccgtccgcctctcccgaccgcatccccaggcttggactcccgtctgcttgggcggtccctcccggccacttttctttctccagggcttcttctggccccttccctgacccacccagcactaatgcggtctgtgcccctctgggagccgcctcccctctcctcttcggctcccctcgcggggagtgcccgggcttttcccgccagcccgagctggtgcccctcccgagagctggccctgggggcgggggcggggccgagctcctagcgggaactgcgccctccaaggcgtccagtcaccttttcgtgggttcctctcacagcgctcggccgtcgagcggggtcgctaacccgcactctcttcggacctacgacatcgcggcttctctggcgttggccagtcagccacaggtaaaggctggaggctggttggctggagtcctgcctcagtgggctccctctgcgcttggggctggggacctggctgtgtgctgtggagctgctttatattgccgctcttcaagcaggctgtgagagatctggtactggaggagggtccccgagatctcagaaggggcacagaatgcttctgtctcctgtgttggtttgtaatggggcagaaaaaggtgttcctccaacccttaacattgaatgaggtgggatttggggtggtgaaatcatttggttagaattctggtggcttgaaaagtggtgactttctaatcaagcttttcttcccccagtaccctgcttcttcaggattagaggacgtaaaattccagagtactgtgcttggcagggttgaccctagaccttgtatatttgtggcaaaaatgagtcttctgtacatcctggacctcctatatttaactggcttattttctgctctttaagctccccacccccacctctcataaatctattaatattgaggtattaatgacttaagacttttgtcgctgtgggaacaatgtttaatgcagagacgtggccttgatgaagttttctgcgtttttggttgtttggtttttagcaccctagtagaaaagcaccaccaacttggcttgtgaggccctttttgggcagaggatgaacatttctggtaacacaatttcaggtgtctcactcttggtcagagcagtgaaatggagctggaggcctgttctggggtaattgatctgtgagtatatgtagcattctggctctctgagcttgttaggctctggttgttaggctccattgagctggacactgtgataagttctttacataaaaatgcaatcctcacaataactctatacagtaggtgctacagttataaccatattatgatgaaaaagagactgagaagttaagtgccttgccctcaaaatctcggaggcagagcttgtgttcctatcctgtcacaccacctctgttgtcttagatgttgggaacactgaatagctcatggatgaggactaagtgattaaaaaattgtcttccaagcccaagtatatgtttttctccttgcttccaccttagatgcactgccgagactatggactacttaccttactgatgtcttacccacttcatttccaacatgggccagttgccacgttaccactataagtacacatccctgagtgtaattagatgaatgaaatctcccgggttttcagctctgtggtaattgtcctgaagttaggggagggtaaccctggattctagggatgtgtgcctgactcaacttcttcctctcctgctggctaggggagaaatgagggagtggtaagtgatatggatttcctgacagccataccagagagcctgagggtgatcgtgtgctagttttgtcatgggatggatggagtaccatagacaaggataggaagaaaatgtcctccctattcccatctctgggactttgctcaaactgttcctttttttcttcctaaaaagctaactttcctccctcattccccctcccctgacattaattcctatccatccctcaagattgagttctaaagtcacctcctttggaacggccttactgaacacatacttcttcccccaagcagaattgccagttatcctgtgtcctaaagcactttgtttacacctcagtaaagcccttaacactgcttagttgtttttccacctggaaggctgtaagttctctaagggcaaggtctggatctcggagctccctttgtcttaaatataagatgttggcaaatatttgtgccagtaaccggacataccatgccattccttcaaggggctgaggtgtagtgatggtggggttgaggtacagaagacaccttcctgaggcacttgaaataccacagctaggaatttgccctgaccaccctatttaaacgtgtaatcccttccctgaacattccatatgccctttccctaccttattacattgttcttgcttattgtctgccctcccactccctcacccaccataacataaacaccctgtgggcagggattgctgtctgttgtattcaccagtagactcttggacccagaacagtccttggtacatcataggtgcatactaatatttgttaatgaattaatggcattgccattctaggaatttggcactcttggagttaggcactcctggacctgaaactaagcctacccagtttgtcgccctacaggtgtaagtttgccccaggcccaaaactcagctttacttctgctgatttttgctttgagattgcattcctgatgccaactttgacctagttggaagtacttcctctctcttacttttttttttttttgaggcagagtttcgctgtgtcgcccaggctagagtacagtggcgcgatcttggctcactgcaagctctgcctcctgggttcatgccattctcctgcctcagccttctgagtagctggaactacaggcgcccgccaccatgcccggctaactttttgtgtttttagtagagacgggatttcaccgtgttagccaggatggtctcgatcttctgacctcgtgatctgccctcctcggcctcccaaagtgctgggattacaggcgtgagccaccgctcctggcctctctattttttaaaagtatgagtctctgggtggaaatctctaaagtttaaaagtggaaatgtaaaaatgttgtgcttcttgttggtaggaagggggactgcactgggaggaaggggtgtggattgtcagatgtcttgaggcttttcaggcttctcgcaagatcaataagaggctggagaaagttactgtgcaatggggaagtgaacagctcaaaagaataacggatggcacaaattaggcttctggtttcaagttacccatagccttttaggtatgaggtggttattggattatggaactttatggaaaagccgtagctgagtgctatttgtgttgtacttaactagttttctaccaggatgactgtgcagtctggagaaaccactgtgtaacataaaagaaaaaagtgctattctgtttaaaagtgttttgaaatgttcagaaaggaagaggccagaatctcttagaagacagacttggaaggagttgggcccttcaaaaggtggtaaatatgtgattctcatcatttaatatatgttaacttatttgaaactcaaatttgtacaaaaagctgaccagcttctttttctactaaatttgtctccccagcctttgaacattgcagtgacctggggttcagtccctggacttttctccatctaaaatcttcacagaggctctcatccagctgcatggctttgaagaacatctgtctagactgttgtcactcccaaatttatgtttgttacccaggcctttcttctaagctgcagcctcatatatccaatgacctatttgacatctctgcttgcctatcagatagacctctcaaatgtaacgtggccaaaacggcactcccgattgcccttgtattcccaccctcttccctcagcactccctgtctcagtaaaatgtcaccatcatccattcagttgctcaaaccaagaacctaagatcacccttgattcttctttttctatcactgctctccacccaatttaattcatgagggagtcctgctgacctgatcttcagactgtatcatgtgttctgccacacgtctccatctcctctgcctgtcaccctagtccaagccaccacacgtctgccacaaacattcttgcataatgctcaaggatatatatatacacaagtatttttgtgggatagctttctaataggagaattgttaggtcaaaggacatatacattaaacaatttaaataggcatcaccagagtgacatctaagagggtttaccctttcaccattgcgagtggttttcctcctgcccttgctgaggatggatgacgcttttaattttttccaatctgataggtgaaaaatagtatctaactgatttaacttggcatttctctgatcactagtgtggctgagcatcttttcatttgtgctagctatttgtatttttccaagacttgctcctttatatcctttgcacatttatcttttgggttatatatttgatttgtttgtaagaacactatatttattagttatatttacccattgcctattatatagtgcaagtttttttctctctagtctgtcatatgtcataactttgttcatgatgtgtacccctctcgtaatcagataaaacccactataaaacatttaaaaaacacgttcattagatttggcaattaggaggccaatgacaacatcagtgcagcaggaggagagaaggcagatcgtagagggttgggcagtgaggactgagaaggactgataaaaaatatggtagatacacatggacatggagagtgggatgatagacaatggagactcagaagggtgaggggtgggagaagggtagatgatgagaaatttcttaatgggtacaatgtatgttattcaggttatagataccctaaagtctctgacttaaccactgcatatgtaacaaaattgcatgtgtaccccataaatttatataattaaaaacatgtagtatatacattgaagaagcttggctatgatgggaaggagagagtgttccttatagacagtaaggcacaggggataaaaaggctgttttatttaattttgttttactttaaatataagagatagatgagcccatttatgtgcagatggcatacagcttgatgatgcaaggtccccgagaaagtcagagggtgggagtgccagagtgaaagaggagaaaagactagccttagagaaaaagtggtggctcttccattgaaacaagaggattcaccaatcctcttggtaaaaactatggagaaggaagtacctgtggagggacaggattttgagagagcccctccgcccccaacaagagagtgaaaggttcaccagagagtaaagaaggcaagaatggtgaagggttggaatagcatttgagagagacgaaaagaggagttctttaggggcatatcatccaggttatgtatgtgtatttcaaaatatcatgctgtacaccataaatagacacaatttttgtcaagtatacctccataaaactggaaaaaagttttaaaatggcttgggtaacttgaatttgtctctgcctcaagtcgcagaaccctgtatccattctgtctggcagcactcatcagaccaggaacagagtgtggacaatctagtatggggaattttttccgggtggccgtgacagaaatagggagagggctggagattggatggccctggcagaagaatagttgaaatgatggaccactgtggctttcatattcatatctgtgactatctaaacctaacttgaccttgagtaatttttaagaagtagaaaatttccatggcatctacactgcttcttgtttgtagctctatcgattcaggcatcagaataccattagtatcagtgtctttaaactcatcagaaagcgtgatttgatttactgagggcctatgttgtgccatgctctgtgttgatttactgaggatttacgttgcaccaactgagagcctacagtcaggatcctacaatgtagatttatccatctatccatccatcaacccagctagatgcttgaggtatggctgagaagaaggtagacaatggccatttttctcctggaacttatttcggcaggggaagtgtatattaaatattgtatcacataattttttaattacaattgtgataagttctgtgaagttcagttttcttagaaatcagattgtcacattgctttttaacaggccttactaatttacatttgccaacaaaatatgagaatatctcttaaatcctttttaaaaactgaaaattgtctttctgaaattttgctgaattaataagcaaacataaaaaaatctttattgccagtaagagtgaaactttttctttttgatgtgtattggccatgtgatttttcccctttaagaattatctattcacgctctctgtctattggatacttacctcttcttgtttttaatagatctctcattccatgtttgaaaccattagctacacttctctcctttctctcttagccctggtgaccttaaaatattttcccctagtctctacggccattcccttttgatctcctgtgaaatttttttcttacctagaagtgttgctgtgcttagggatgggactacatttttattacttgactcaataaaaggtaacatataaatcttctgttcctgcttatcccactctccagaggtaacaatgttaagattgtatttctttctagacatttttccattcatccatgatccaatctgtctaaaatgtaaacaaataaaaatggaatcataatatatatgatttgcaatttttttaatttaatatgctttcagtgtcagtatatatagaactacagtaccttcttctttttttttttttcttttttcttttttttttttattgatcattcttgggtgtttctcgcagagggggatttggcagggtcacaggacaatagtggagggaaggtcagcagataaacaagtgaacagaggcctctggttttcctaggccagaggaccctgcggccttccgcagtgtttgtgtccctgggtacttgagattagggagtggtgatgactcttaacgagcatgctgccttcaagcatctgtttaacaaagcacatcttgcaccacccttaatccattcaaccctgagtggacacagcacatgtttcagagagcacagggttgggggcaaggtcacagatcaacaggatcccaaggaagaagaatttttcttagtacagcacaaaatgaaaagtctcccatgtctacctctttctacacagacatggcaaccatccgatttctcaatcttttccccacctttcccccctttctattccacaaaaccaccattgtcatcatggcccgttctcaatgagctgttgggtacacctcccagacggggtggtggccgggcagaggggctcctcacttcccagtaggggcggccgggcagaggcgcccctcacctcccggatggggcggctggccgggcggggcgctgaccccccccacctccctcctggacggggcggctggccgggcgggggagctgatgacccccccacctccctcccggacggggcggctggccgtgtggggggctgaccccccccacctccctcccggacggggcggctggccgggcagaggggctcctcacttcccagcaggggcggccgggcagaggcgcccctcacctcccggaacgggcggctggctgggcggggggctgaccccccccacctccctcccggacggggcggctggccgggcggggggctgacccccccacctccctccctgacggggcggctggcctggcgggggctgaccccccacctccctcccggacagggtggctggcctggcgggggctgacccccacctccctcccggacggggtggctgccaggcggagacgctcctcacttcccagacggggtggctgccgggcggagggactcctcacttctcagacggtgcggctgccgggcggaggggctcctcacttctcagacggggcggccgggcagagacgctcctcacatcccagacggggcggcagggcagaggcgctccccacatctcagacgatgggcggccgggcagagacgctcctcactgcctagatgggatggcggccgggatgaggcgctcctcacttcctagatgggatggcggccaggcagagacactcctcacttcccagatggggtggcggccgggcagaggctgcaatctcggcactttgggaggccaagggaggcggctgggaggtggaggttgtagtgagccgagatcacgctactgcactccagcctgggcactattgagcactgagtgaacgacactccgtctgcaatcccagcacctcgggaagccaaggctggcggatcactcgtggttaggagctggagaccagcctggccaacacagcgaaatcccatctccaccaaaaaaatacgaaaaccagtcaggcgtggcggcgcgcgcctgcgatcgcaggcactcggcaggctgaggcaggagaatcaggcagggaggttgcagtgagccgagatggcagcagtacagtccagcttcacctctgcatcagagggagaccgtaccttcttctttttaacaaaggcacaatattccctaatatgtgtgtacaataactagtcagtttcctttgatggatgtttatgttctttaatttttttttttttgctgtttcaaatattgagcatcctcagaatatatatttgtgaatttacttgaatatcagcagaataagtttctcaaaatgaaatggctatgttaaaaatatggtcagtggtactaaagatccagagaaatctaggaagaccaagaactgtctattggatttaggaagttcttggtgaccttagagcaatttcagagaactgtgaggcagaaagctaaactatggtgggttgagaaatgattggagagatgaggaagtgaaggcagtgattatgtacaattccttagagaaatctgtctggctttgaagagcagagaaagggtagtagcaaggaaggagttgagattgaggacctgttatttatttatttatttatttatttaggaaggacttgagtttctttaaaggctggtgggaaggagggactaattaatagagcaaaatccttggaaggcaaagtccttatgccagatgggaggggatccagattgaggtagaggattatcctcaataggcatagatgaaagtaggttcatagatttggcggcaggaacttgtctgatggtatttctatttctctatgatataatagttaaggccaacctcttagagcaggggttaagatgggacaaggtttgagttagatatttgtggtatttgaagaaggtttgaaatagttattgtggagaacaggagagcagcctagggaagcatagttgcagtgccaggcagggttaagatgagcttggtgaccaagaattcatatggataataatctaccagagtgtgattttttttttctccagtagatctcaggagtccttgtgcatgcataaagtataacagttgggcttagaagagctatggttttttaaatcagatatttgcagtgaaattatgcattattgaggatattgacaagagtgcagttgaaacaatagaattggctgggtgcggtggctcacaccagtaatcccagcactttgggaggctgaggcgggtggatcacctgaggttaggagctcgagaccagtctggccaacatggtgaaaccccatctctactaaaaatacaaaaattagccgggcatggtggcgcacacctgtaatcccagctacttgggaggctgaggcaggagaatcgcttgaatccaggaggcagtggttgcagtgagccaagatcatgccactgcactccagccagagcaatagagaaaaagtctcagaaaaaaaaaagagaaagaaacaataaaatttaaatgttattgggaaggaagtaaagatgggaaggagctgaggaggtgaaagcagaagggtctatggaagactgcccccatccaagaaatctgagaacaggaatggggctagttggggggctcattggctgaataggctagaagcacagcaggttgtggtcagagagggggtgttgaatcagtgatatcaaaggtggagaagtcctagatgataagctcttgggtgtggctgaatatgatatatggtattcttgatgccagctcattcattcaacaaatatttattttgtgcatattatgatccaggcagtgctctaggcaccaaaggtacagaaatgaacaaaacaaagtcccttctgtcatacagcttacaatctagtgggggagattatttttataaactaaaagaacatccttattgatgtgctgattcctgtatgtgtagctttatttgtaactaatgataataccaggatcaaatatttacatatatgggggctaagaaggtccatctaggcattttgagtatcttgctttatctcaagttatacttactgaattatgaaaactcatacctcttttccccttagaactttttaaggtatttttacttactatgtcagtattgaaaataaacaaatatatacaaatctaatttgaatatttcattggttttaattttttatactgtattttttaaaaatattaggatattgcttcaagctgtagaccagatgttgataatgcatgtactaatcttgctctagggatttgatgtaatgtgtaaagtaattatggttaagcagtttaggagggaaagagggcttgtaataagttaatattttatgtttatttttatattattctccaatttattttattatttatacctaccttttaatgtacatatggtcatgtatatatttattaatattttatttgaaagaaataagcatttatttggcatcttataggcctcaagtaacactttaaaattacctgccacgtatgcaattcaatttaaattcaactacaggttattttttattgttttaaggtttctgtggccatagccagatcacagcatccctaaaattaaaaagaaaccaaatgcatgaaatcacagttatgtgtgagcatgggctggattagtcatgaaccatgatgatttcacatttaaggggactgtgtgggtaatttttaggtgacatggtctgcaagaaataatcagatgccagttagagttcagtttagaaatccccaccatctgtgatcccagcaggagaagagggtcttccctgcgggagtgctgcattatcaaagcttgttgactaaggaaagataatagtgttctgcgtgggaggtgatgaggcttattgaaaaataacaatgtgtcagctctcactggacttaaaaatgttttgtacatataaatgacctagattttaaaacagtccattcttttagttggggattttagattttttaaaaatctaaaaaatggggctgtcaaggaaggggcttttggcagagaagagggtaaactggccatcctgcacccatcagcctatgaggctcttgtgtctggctcatgttagaggaagcttcaaatgtagattttgaaagctggaaagctaaatgggatttgttttaatatatgtattttccctgttgccaagtagggtgtttggacacatggtctttataatattttagagttacttctatgtatcacatttatggaaatctgccttctaggattggtggtgggtttaaggcaccttctagagttgctgaggagcaggggacaaacgtgtagaatcatgaaggaccacatttccacatatccaaaacaaccattctgcaggagaaatgaatatatagtattaagatatctgacttccttctgggacttgttttagagttgtatatattattttaagtgggaatttctacaaaccatttatgaacagaatttgttggtattgaaaggtagctatgtggattccatctggaggaaattgtccccacatatgattctaaaagctaacaaaagaggcattttagttactaccactgccttcttccaccctgctgcccacccccaccccctgccccaccattatgcacctgccatcttttaggatggatgtcctggatgaggggaatgagttattgtcttgcgtataatgttgctttgagctagagttgctctggcgtgttacacatattgcaggaggaggtcaggggtctgggaaagtaagccagactgagggcctctcaaacattgtgtttgttattagctgaagacttttagaaaccccacctcaagttcctgaggttgatgttcccttttccaaaaatcaccatatagagcaatattgccagaatatgaagagacagtataatgtaatgtaacggttaagagcttggactctggaaccagacggcctgggtccaaaaaccagactgtcacagggcatgtgaccttgagcaagttatttgctcaatctgtgcctcactttcctcatttgtaaagtggacataataatttagtacctacctcatagtgtgattgtgaggactaaataaagtgcttagaagagtgcatggtacataataaacattatagaagtgttaactatcattgtcatcatcttcatcagttggtggatatcttaaaaggagtgaaaaccggccaggtgagatggctaatgcctgtaatcccagcacgttgggaggccgagatgggcagatcacgaggtcaggcatttgagaccagcctggccaacatggtgaaaccctgtctctactaaaaatacaaaaattagccgggtgtgatggcacacacctgtaatcccagctactgggaggctgaggcaggagaatcccttgaacccaggaggcggaggttgaggtgagctgagatggcgctgcctaactccagcctgggcaacagagtgagactccatctcacaaaaaaaaaaaaaaaaggagtgaaaagcacaaaatgcctcagcacatgcaaactctacttttgtagaatctattttgaaaaggatcgtagggagccaaaaccttactgcaaaatcagaattttgtaaaattaagagctagttgtaaatttctcattgttagggaaaaatacagctttgctcccatacaacttttgagaatggatttgtgaaggcaggccctaggggattttatgtgaggcatagatgtgctccatggatggacaggtgagggtctagaccccagctgactcctaggaagcctcagttgccctttggttttggagccttgatactgactctaccagtttgtctccactcctatttttcttctttttgatcctatttttaaaatttatgatattttttgatgttttatgaatctttgtaagtcactttaaatcctgtctggaacagtgtataaataaatatcctttaaactgatcatatctaattactaacatttgcttcatatttatgcttgtcagcctccctccatgcagagaggtacggtgaccttccatctaggcaagaatactgattagatttctcaaatttcatagaaagatgtcaaaactgccatatgctcatatattttccaaagcatatggttaataataattaaaactaaacagctaccaatattgggtgcttactctaggccaggcactatgctatgccttttactcatgatgcatgcttgaatcctcaaagccataggcaggagctcttattattaatcctcatttttacaaatggggaaacagactcaaggaggttaaataacttgcccaaagttaattcagggaaaaagcaaagctgtgattttaacccaggcagctcagatccagtgcttttaagcacaattctatgctatactgtccttaattagaaatctagcacatcagaactccaagtcctagtataagaggccgtacttgtgttacagaacattcacaggtcctgcagattttctctccgtgtaatgtctttaatatgcccctttccatctctagtgccactgccctctactcttggctcttgttatctttcccctggatttatgccacagcctcctcaaatccatagtctgcaaaattgtcagtgtgccctaacaagtccttgctttacataaaactcttcaatgatttctgttgtcaaaggctaattagccgtgtttttgcgcgtagcatatggagcacccgccagccacacatgatgtgattccccacctgcctcttccgcattctcccttacaatttaaaccaaccagcatcattgtattacttgctcataccacgttgctttatgcctccatgcttttgtaagtgctacgcactttgcctggaaagccctcgttctcctgcttatccagctgaaaaacattaatttacaatcagttcatgtgctactgctggatattctctttctagttccctttccccaagctgaattatgtgccctcccttggtattcttataatatctcatgcatatatttctttggttaccatgttttttttttaggattatttaagtgtctctgttactaaactgtgaactctgtgggcatggactagctctgttcttttcttcttagccagctagtgtaccgcttagcacatagttggccctcctaactagtgagcattctgtaacagtgcagaatacagagctctaggacagggaaagaagtaagatttggaaggcctgaaactgtgcacacattcaaagataattaccaggacagcagaaggagctcttgcagaaaaatctttggggccaggtaatttacattatttaacccaagagccagaaaggatgtggggagatgggagctggggtctgaatccaaagggaactttgaaacttctaagaagccagacttagcagctttataaattgaaacttccttgaatttgtctgagtagcctggaataggtatctaagacagttacattttaataagaatatttatagttttctaggagagacatcaccctaaaattgaaaggggcagttgatacaataaccaacacaatatcccaaagcaattattttattgactgtaagcaatgttgtatgctcatgcaaatgttaccagtaagatgttatccattggtatttttgtgcataggtggctggatccagacaaggggattttaggaagccctgcatccctggaagctttcttttctacttgagtttttttcttttttttttttttttttttaagttttgcagaccaccatatactctggatttggtttcatttttccgtgctctaaaatcaacttttttttttttttttttgagatggagttttgctcttgttgcccaggctggagtgcagtggtgtgatctcagctcaccgcaacctctgcctctcaggttcacgtgattcttctgcctcagccttcccgagtagctgggattacaggcatgcaccaccatgccagggtaattttgtatttttagtagagacggagtttctccgtgttggtcaggctggtcttgaactcccaacctcaggtgatccgcccgcctcggcctcccaaagtgctgagattacagacgtgagccaccgctcccggccaaatcaactcttttacctttagattatcaaataactagtcccccgcccatcggtactagattttgctaccttttagggctatgcttcacccatgttctggaaacccacacaaataatacgtattagttttgacagtactttagcttgatctgctttagatgctgtcattgcctttgtcacaattagttaatagagtccactttttttttttttttttttttgagagagagagaaaaggtcttattctgtcacccaggctggagtgcagtggcccaatcttggctcactgtagccttgacctcccgggctcaggtgatcctcccacctcagccttccaagtagctgggattacaggcacataccaccacacctggctaatttgtgtgtgtgtctgtgtctgtgtgtgtgtagagagatggggtttcaccgtgtagtccaggctggtctcaaactcctgggctcaagagatcctcccacctcggcttcacaaattgctaggatgagccacctcacctagcctagagtccacttttgaatgtgtcttatgacagcaaaaattcttattcattatgctgtactacttgcataagagcaactgcattacaatcatcagaatgatttattctttcctaattaacatacatcatatctctatgcaagtagaatcatgaaaatatatggcaatttgtagaatagtttcccttaaccagcctttaagtaaaggacttcctagcttttttgattactcacctttatcaccccaaatttttatcactcctaaaataagtatttataaactacattatttaccactgtattggtcatatattataaagcatgcacaggccaggtgtggtgtctcatgcctgtaatcccagccctttgggaggccgaggcaggaggatcacttgagtctaagagttcgagaccagcctgggaaacatggtgaaaccccatctctacaaaaaataaaaacaaagtagccaggtgtggtggcttgtgcctgcaatcccagctactggggaggctgaggtgggagaattgcttgagtccaggaggtcaaggctacactgagctacgattgtgccgctgcactccagcttgggtgacagagtgagactctgtctcaaagaaaaagcacaaaaatggaaataaagaaggatgagagattaaatgaacttttaaaaaataattctaatatttattaatggtacaataacctttgctctcattttgatgaggccagtgacattaaatgtgcttcatttaaacaaaattttggtttatgatacagctacttgaacatctgattctaacttctgtttatttttatacttgattttaatgactgatgcctcacaaagtatatacattttaaaataaaagaagtatattgtttggatgcacttactaaataatcatactcatattacagttccaggcaccagttatgcaaacattttattgctgttcctgaacctgctgtcttttatgtttttgacaaattgaaaagttaaaacgtgaaacatcttttagataacaaaactgtgtagtaagggaaatatttcaaacctactctgtattgtttattctctattaaaaaaccttggccaggcacggtggctcacgcctgtaatccccgcactttgggaggctgaggtgggcagatcacgaggtcaggagatcgagaccatcctggctaacacggtgaaaccctgtctctactagaaatacaaaaaattagccgggtgtggtggcgggtgcctgtagtcccagctactcgggaggctgaggcaggagaatggcgtgaacccaggaggcggagcttgcagtgagccaagatcgtgccactgcactccagcctgggcaacagcaagactccatctcaaaaaaaaaaaaaaatcttgacataaaatattttagtgtttcaattaatttaaaggctcctagtgtcttgtaggtattctgggattggaaaacatgattacaagaagaaagtttagttacatttaatattaaaatgtttaaaaacattttattgaactacaatagacaaattatatataaagtatacaatttgacaaattttgacatctgtatatatccatgaaactatcaccagaattaagatattgaacatctatcacctccaaaagtttccttgtgccatgttgtaatccttccttcttgtccctgtgtgctattaccctccttacccccgtcaactcctgaaaccactgattctgttttctgacactatgtattttctagaattttatataaatgaaatcatacagtgttttttttttgcctgacttatttcagtcagcataattattttgagattcgttcatgttgctatgtgtatcagtagttcattcttctctattgctaagtagtattccattgcatgggtatactacaatttgtttatccatttacctcttagtaggcatttgggctgtttccagatttgggctattaccaataatgctgttaacatttccatgcaaatctgtgtaggcatatgctttttttttttcccccttttgaggcaaagtctcactctgttgcccaggctggagtgcagtggcgcaatcttggctcactgcaacctccacctcccaggttcaagcgattctcccacctcagcctcccaagtaactgggattacaggcatgcaccaccacacccagctaagttttgtttttgttttcttttgagacggagtttccctcttgttgcccaggctggagtatagtggcacgatctcagctcactgcaaccaccacctccctggttcaagctattctcctgcctcagcctcccaagtagctgggattacaggtgcctgccaccacacctgggtaattttttgtatttttagtagagacggggtttcaccatgttgatcggctggcttcaaattcctgacctcaagcgatccgcccaccttggcctcccaaagtgctgggattgtgggtgtgagccaccacgtccggcctacgtatgcttttgcttttcttggataaataccaaaagtggaaagcctgggtcatatgggagatatatgtttaactttttaagaaactgctaagctgttttccaatatggctataccatttcacattcccactgtagtgtatgagagttccagttgcttcaaatgccggccaacatttggtgcattttaaattttggtcattctaataagtatgtagtgatatctcattgtggttttagtttgcatttccctaatgattaatgatgttgatcatgttttcatgtgtttatttgctatttgtatatcttctttggtgatatgtttattcatatcttttgtctattcatatcattgtctattttttaaatttgtgtttttaaaaatattgtagagttctgagagttctttatatatgctggatataagtccttatcagatatactagttgcaaatattttcttccagtatactgcttatctttttattttctaataaagttcttacaaagcagaggttttaaattttgatgaagcctaatttatcaagttctggatcacgttttacgtgtcatgtcagaaatgcttgctttttttgtttcatatggatatctagtttttccagcactacttgttgaaaagactgccatttctccactaaacttcccttaacctttatttaaaaaatcaagtgactataaacatgagggcttatttccatactctctattctgttcgtttatttgtctgtcttcctgcccagtaccacattgacttgattactgtggatttatagtgtctcttaaaatcaggttaagtttccgctttgttctaccatatgttttgaacctcacaatatatcgttatttttcctttaaacggtcgattatattttaaaagagatttaaataataagaaaaaagtatttttacctacattgttaccattgcatgtgctctgtatccctttttgtaaacctatatttctgtgcagtaccattttctttctgcttcaaggacttcctttaacactttttatagtgcaggtctgctggtgattaattctttcaacttttgcatgtctgaaaaagtctttatttcacctctgtttttgaatgatatcttgctgggtgtagaattctatctaggttgatggttgttttttttctttcagtattttagagaggttgttctgtctttacacttgcattgattccaatgataaatttgcttttatcattatctttgttcatctgtatatatataatgtgtccttccccaagaccccaaccccaccccaccccaccactctagcttcttttaagattttcccattgtttctggttttaagcaatttatggtgtgccacatggtatatttttctttatgtttctggtgctttatgttcatagagcttcttggatctgtgagtttatagtgttcaccaaatttgggccattatttttggtgacatcaatgacatgtatagaaggtagcttgatgttgtcccatagctcattaattcctttttctttttttcagttttttctgtgttccattttgaataatttctattgctatgtcttcaagttcttaactcttttctactgtaatgtccaatttgctgttaatcccaacgagtgtgtttttcatctcagacattgtaccttttatccataggtttgatttgagtctttttacatctcccatgtcccctgcctagctttttgaacatatagaatgcagttataataactgctttgatgactttgtttactaattctaacatttgtgtcagttcttggtctttttgattgatttttctcattattatggatcatattttcttgcttttttgcatgcctgttagttttttactgggtaccaaatattatgaatttgaccttgttgagtactgcatatttttgtattactataagtatacttgctctctgttctgggatgcccttaaattacttggatacagagtgaccctttcaggttttgctgtttagatttgttaggcaggaccagagcagtgcataatctgggctatttcccactactgaggcaagacccttctgagtccttcagctagtgtcccgtgaatcatgacgttttccaatttggctggcggaaacaggcactattcttagccctgtgtgagtgacaggcattgttcttttgaatcctttcaggtagttctttccctggcctagagtaatttcctcacaggcataccatgggctaatcagtcctttgctaaacacttgagtgaaaccttctgcaggcctctgaagatctctttctctttctgtggagctctctcaggtcctctgtcctatgaactccagctacctggtttttttcccagactctcagctctgtctccagaactcagggagttcactaggctctacctgggttcttcctttctgtaccattatctggaaattctcttaagacagtaagctgggaaaatcaaagggctcaccttatgtgttttccatctcagaaatcataatccttcattgcctgatgttcagtgatttgaaaaccattgtttcatgtatttggtacatttgttgttgttgttattgtttcaggcagggtggaaattcattccaccttgacattttataatctccaattatgaccaattaaaatttgtagcccaatttaaattctcatctttcgaaaaaagtgtagacaccatcacatttcttgacgtagctaaatcagttctgaatacccatgttcaaaagtatacagaatctggcatgcagcagtataaatctcacatcagtataaaactcattgatcagtttcggtgtaaaacatagtatcattttaaaaagagcagtttaattcaggcttcttggttaaatgaatatattttgaaagactctggttcactttttcatgttcagtgaggtattgtccattgtccttagcctaaacagcaaaatacttttattacatcactttggcaggatatgataatccattagaatgtatttgcaaaaccatcatataattactacttataactttagagaataatttaatatcagttcagccttttggcccttgagcatgggtcaatttttaagaaaatcttctgtcatctataaggctgtcagcatggttcctcacttcaaaaacagtggcctgtgattaatgcattaaaattaatcactataaattcatccatgtacccaaaaactacttgtaccccaaaagctattgaaataaaaaaatttaaagaacaataacaatagcctgaaactttaactgacgtctagacagtttaactcacaattcatctgcattctttaaaagaaaataaatgtcattttctaagacctagttaagtccgaaagcacaaatgaacatatacaaactgacaaaaataggtaacacttagcattctttgtgttctcattactttaagcactttacgtattttaaaaactcatttaatctttataaaaacaagccccaaaggataggtacaatttttatcttcattttgcaagtgaggaaattgaggtactgagaggattagtaacttacccaaggtcacacagctagtaaatgtggaagttgggattcaagttcaggcagtctggctcaattccaagctttttgtttgtttgttttatggacacagagtctcactctgtcgcccaggctggagtgcagttgcaccatcttggctcactgcaacttccgcctcccaggttcgagccattctctgcctcagcgtcctgagtatctgggactacaggcgcaagccaccatgcctggctaatttttttttttttttgtattttttgtagagacagggtttcaccatgttggccaggctggcctcaaactcctggcctcaagtgatccacccgccttagcctcccaaaatgctgggattgcaggtgtgagccacccacctggcccagagtccaagcttttaaccacagctcacacactgcctcaggaaaacaaaaacatttttctctcagctctattacagctcttcaatttccatgggtttaagtttaaacatgtaaacacagatagatttctgggtaaagacattcactagacttttgttgaactcatactgtgtgtcacacactgtgccaagctcctggggctatgatatccagatatagtacctaccttcaaagaggttacgtctggtagatgtttctagtttgagcataagtaccatatattaccatcttcacttttatgtgtggcctgcatgcaacacagcaaaatctgttgtatttgctgtccagggcagggacattacttgtgtcttcctaattcacatcagttttcattttgggaacaccaatgattacttttaatctgagtactattcttacaaggaattctatattttagtcatctttttaatattctagtctcatgcccaaggtcatatagctaaaaatagcagagctaggatttgaacccaagtctgtctttcaccactattttcattattctatgcttcctgtcaagttttgcctagcttttcatttttaaaattggtctttagaatttgaaataatttgagatagctcacccatccccttcttgaaaaccagttgtgttagtgtttattttcattcattgttattatttctcaatcattaggattaggatatagactggatatatctagttggatatggaattctacatatgtcctttagatcaagcttattgtgttgttcaccttgtctacatatttactaatttttcatctgttatactatcagtaattgagagaggtatggtaacttcccatttttatggtagatttagtttttcctttggttttgtaagtatttgcattaacatattatcctcattttttagtagtaaatatgtataattgctaagtaagccatcttttcttttttttaattttttttattatactttaagttctgggataccagaatgtgcaggtttgttacataggtatacacgtgccatggtggtttcctgcacccatcaacccgtcatctacattaggtatttctcctaatgctatccctcccctagccccccacccccgacaggccccggtgtatgatgttcccctccctgtgtccatgtgttctcgttgttcaactcccgcttatgagagaacatgcggtgtttggttttctgttcttgtgatagtttgctgagaatgatacaaaccaccttttctaaaatatatttttatgggcatgggtcccacaaggatgctatattaagatacttcatctgagtcttgacacctcaggactaacacagaacaagttgtccatctgagctcagattctgacactcatgttacctgagccgtggtcttctcaatagataatcttgcctttttgactgtacacctgggactgaatgtaatgaagggtcttaagttttcttgggctttggtttctctattaaaccctagtagccataaattgggagtatccgattagtcatagcttttctaacttcacatctatctggttttcttattataactgtatttgtgcctccattattttcctgagttctagttttcaaaatatgatgtactatttaccataaaaatatatcacttggtttattgcatatgaaagctgtatttttctttcatattttcctttttgaatttctagagaacattctatgccatagtatggggagtagtgatggtagtgaggtaggaggcaggtattttcctctaagatgttaaggatagatttagtaccattatgatctcttctttgacatgtgggttatttagaagtgtctttataaattttaaaaaaaagtattgtgataagaaattaccttattttaaattgatttcttatttaatttaatttcctcgaagtcagagactggtctgtatgggaaggattttttaaaaaaattatgcagacttgcattacagcctagtacatggtcagttttgggagtaaatattctatatgtgcttgaaaataatgtaattctccagttggatatagattttttttgtattcctattaaatcaagctcattttgttgttcaacttgtctatatatttactagtttgtatctgcttgtaccattcataattgcaacaacaaagaagtatatgttaacctctcattttgatggttgatttttcaatttctctcttttgttcctttgtatatttagtgatgttttattagtgggtgcatatttattatctctatgtagtgatcttatctaacctttataaagcttttattgtcttttttacttttagatattaatatagctacctcagctttcttttggctagcatttacctggtatatcttttcctatctttttactttcaattttcccttcaatttatgttttagatgtgtctctcataaatggcacataactggattttttccttttatccagtctgttaattcctgtatttcaaagggtgaattttgctcatatatgagtttcatattcattgatatacttgaacttgtttttaccattttaccttttgttttctctttgtctcagttttttctgcacttacctttgtcttcttgccttttaatttttgttcttaatttgttttctgctcctcattactgattctgcaagatcccattgcaaacaagctggctgttaacagggttagtgttggaaacaacagcaacctatggtggaaggtggggcttggggtgggatatggcttttctgaaaggagtcagattggcaagtgatggggaagaggaggcagggagctgatagagtccatgtctgatggtcttacaaaaacctttttacaagtatgagacaagcatgtctgatgggactggagggaagggaagtgggagtgtgagatgaatgaaggcttgaatagaacccaaagggactaggtaaaggaattgaacaagcataagtaacagaatttatgggtgacaatgagggttcagctgaggttgtagaccaggaattatgtagaacctgggtataggagcagacaaggcaggctagagcattagcacaggtttgggattttcatgggcagttgtggcagagggatgaaggtatatggatatggaaggtactggtgagagtggttcaaatgttgagccatctggagtccaggatgggtatggggggaagatagatcagcagaaggcaagtggaccaagagacaatgtggggctcaagagactgtggtcttgataaagttgaagaacagatagagcaggagtgagctgtggttggaaagtgggaattcttgaatttaagatttcagagggggcagttctggttggtcaggtccataaatgaaaaagaaagggcagatgtacaatattggtagttccattttcttaagatactatctttatttcctcaaggatcttcttacttccctggattttgatattacttggtctcattattatgccaacgtgcctttctcatcacaatattctgctgcctctccacaagcaccagtttttaaatctggtatggttctcatttctagtgtgcctgtgctatccttgctttttagctgacaggtaactgataatacctcttttatccaggagccactgatttttttgcgcagtgtttcagccgtaatcacacatatgggaattcatttccacaatgcttttgatttgtctgtttagtactttatagttgctttggttataattctgcctagactgagcctgtagagcaccaactctggtgtcagattgcctgggcttgaatccctgcaatttcacttacttgctctttattcttgggcaagttagcctaacctctcctgaatcctaatctatacaatgggggtaataatagtcactcattcttggtattgtggcaaggattaaattagttaatatatgttaggtacttgtttggcgtatagtcaattctcaataaaagatactgttggggtgacaatgacagtgattgcaatattggcagcatatgcaaaattgcataccagatattgcattaagtgctagggcagatacagaggagaagattgaaaaagtccttgttttcatggagggtatatattctccttggggataagaactaagaacacttcctcaagactgtctaagaaagggtgtgtgcaagaggcttaacatcttatagttcaataaagaccaggaaatatacaagttgaggaaatattgaggtttcaggaacctgtatagctttgccgtgttgtttatgttctccactgttttgtagggaactagtaaaaaaagaaaaagaaaaaataaagtgaaagaggcgtgttgtctagtttcaaaggagaggagagaaggtaagtgtgattctcatttcctttttcactctctgtctaccttgggctctttgactcccatgactaccaagtgtatattatcagatacattttttcttcctgaggtccagccctgtgtctccaactatttcctgggcccagttacctggatatcaagtatgcaacactaacttaatagggttaaaacaaaactttttgccttacttccaaacctgtttctttccttacatcttctattgctatgagggctgtcactagccagtcagttgtttaatcttgactgtgaactaggcatctttgacttcaccttcttcatcctctctgctcagtcagtctccctattctgtcaattctacttctcaaacctattctgttttttcttgctgcctggctcaggcctttatcattttagaagattcagcaagtatttgtactccaaacattgtgattggccctttaacacacattatttaattttttaaacaacgtttgaggtgggtcgttttgtagatgagaaaccaaagagtcagaaataaaatgacttctgctgggcacggtggctctgtctatagttccagctacttgggaggctgaggcaggaagatcacttgagcccaggaatttgagtccaggctgggcaacatagtgaaactctgtctctaaaaatgaaaaataaaatgaaatgaaaaataaaatgactggtctaattgtttagaggcacagttagtaaatctagattgtcttttgctgcagtattgtaataatatctctgcctcatttgtattgttttcttttttgagatataaatggaagatatatgtaaaaacaaattagaactatgtgaagtaaaaagtgaaagttgccccttcccaattctactccccaagggaaaccaatgatagtggcttttgttctagacctttctctttgcatatacaaatatttagataaattctttataaaagatcattttttattgtcctacaactactttttcactcatggccatatttttatgtcagtacgtgtgtatctaccacatttttaatggcgacataatgttccattatggggacatattattttgtttaatgattcctatgttaaataactgtttctgttcttacaaataatgttgcagtaatagtcttgtgcatatactcttgcttgtgcatttgtatgaatatttctattaggtaaattcttagaagtcatattgcttggttaagtatatgcctattttaaatgtatgtactaccaaattgtcctctgatttgtcctctaaatcagtctttcatattataactagagcgatatagctataatatgtctttgtaaagtgaatttcatcatgtgatttcccagcatcaaaaagcaacatcagagatgtttggtggatttctattgtctatgcagtaaattttaaaattaaaaaaaattttttccagacaggatcttgctttgttgcccaggctagagtgggccacatgtgatggcgtgatctcagctcactgtagcctcaacctcacaggctcaaacaatcctcccacttcagcctcccgagtagctgggaatgcagccgtgtaccatcatggctagctaagttttgatttttctttttgtagagactgagtcgccctgtgttgcccaggctggtcttgaactcctaggctcaagagatcctcctgcctcagcctcccaaagtgctgggattacaggtgagagcctccatgctgagccaaaattcttaaaattttaaaaaagtttttaagagttatgtaatctggtcccaaactatctttcctaccattcttccctaccaggaaatttgtcctctgataaggcaaaatccacctcttctgtgaaatttcccatgtatactgctctctttcctctctctatgcaagatagaatgagttgctttcttccctaagttctcatagcacttaatttatagtcccttataatccctctgatagcacttaatgcgttgtactgtatttatgtgtgtctgtctcccctgctactctgtgattttcataagggtaggaactgtgccttactcatctttgtatccccagcactttacacaatgcctgtcagcgtagtgctcaacaagtgttcatgaatttgggaaagatatcctggaggtagtgctagagtgctagtatgataagaactttgagagatagagtagggggtggaagttttgaagtatagcagaaagctgactgactcctgggagaatggaagctggttaggaatagacaactgggcttaaactggcaggagccttcatgtgcttttctccttcactgcagagaccagctgcctggttatttgggttaataggcttgagatttgagaacatttaaagtattaaaaattggatgattgaggactcacttggtggagggggagattgactcagctgttctatgttctttccagactaagatgcatatactgaataaccaatccttttcccagagtcacgaataactttttctttctgaaaaatcaaggactcttcattttcagggcatgtttcggatgggagtaggaagactaaataggtcagatacttctactttgtctctttagcttggctcaaggggaaaggaacctattgaaagggtttagggctgtgggcctattcttgagtaaatcatctgtgtgaaattagttcttttgtcatttcaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggtaagagttccccaaaacgcatggggtcccaggcctttgaccaatgatgtctgggcttttccttatgtctcccacctgactttcataggaatttgtatatgtgatgtttaccactacttattgggtcacgctgggctctgagtttgttgcttccacagaaccaaatagtcttactgtctttacctctcaacccctctccatccaatctatgcatatcctgaatccacttacgcttctgttttgggtcttggcaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatgtgagtgtcacctatggctgagtagagagggggcgaggccttggccgtggtgagaatttctttcctcagcctttattagacaagaaccattctttatccatctgtcattttcttttatttcttcccagagagttgaagaaagcaactggggactggttttatgaccagaaagtgaatcgctttgcttaccgcacaggtagtgagataatcaggatgtccctgcgccacaaacctgcaggtactggacctgtctagagatggttcttggtatggaatcctagtgtattctgactggtagcatcttaactccatgggctcagccagttagtggagaatagaagattgtattgtcatcccttctgcaagcatggtgtatttcaggggatttgctatgagggttgtttcctttttcccctactcataaccaccaccctggcatacttttctttgtcttgaagtgagtaaaagagagacagtgggacagtccctccttcatcagacacagatgggtgacatctggccaggaagaaagatcattcaggagcggcagaaggagcccaggtaagaatcaagtaattgtttaaagaaatgcttacaatatccctttaattcttttactattctttttacttcttctgtttataaaataatagatgttcattataggaaaacttgaaaagtacagaaaatagtaaaggagggaaaaaatcattcctaatcccactactcatatgtagacattaacattttggtatatttacttagttctttattttttatagtttgcattcgctttctcaggttgaatagtttgttctttatacgaacaatttgaagacaaataaaaataacacatgctcattattaagcaacaaatcacccacattcctactaccccagttttcacattatgtgaaaattatttcgtatatcttctatgtatatacataacgggttgactggatggataaactgaaaaatctttttaatattggatcatagtataataaattaaaatcatcctatttaattttacttgaatttaacagaataaaacactgaaataaaatgaaagaatagctaatcttcagacaaatgtttttttaaagtaaaagatattagttgttaacattcctctaagcttaagaaaaaatattatgaaagccattgagcagttggtcacttttttagtggagtttttttggtaacagccttattgagatatatataattcacatactatacaatttgtccatttttggtgtacaatgcaatagtttttagtatattcactgagttttgcaaccatcccttgaatcaattttagaaaattttcatcacctcaaaaagaaaccctttacccttttagctgtcaccctccctgatccctaaacaatcactcatctactttctgtctctctgtatttgcctatcctgggtatttcatgtaaattgaatcatacaatatgtggtcctttttgacttgcctctttcacttaacattaacgttttcaaggttcatccatgttatagcatgtatcagaacttcattcctttttatagccaaataataccccatgatatgtatttatcacattttatctgttcatctgttgaagaacatttgggttgtttctactttttggttattaagagtaatgctgggccaggcgcagtggctcacgcctgtaatcccagcactttgggaggctgaggcgggtggatcatgaagtcaggagatcgagaccatcctagccaacatggtgaaaccccatctctaccaaaaaaaaaaaaaaaaaaaattagccaggtgtggtggcacgcacctgtagtcccagctactcgggaggctgaggcaggggaatcacttgaacctgggaggcagaggttgtagagagccgagatcgcgccattgcactccagcctggcaacagagtgagactccgtttcaaaaaaaaaaaaaaaaaaaaaaaaagagtaatgctgctatgaacattcattaagagttttgtgtggatgtatgttttcttttctttttttttcttttcttttcttttttcttttcttttctttttcttttcttttcttttgagacggagtttcgctcttgttgcccaggctggagtgcagtggcgccatctcggctcactgcaaccttcacctcccaggttcaagcgattttcctgcctcagcttcttgagtagctgggattacaggcacgcgtcactaagcccagctaattttcatatttttagtagagacggggtttcaccatgttggccagactggtcttgaactcctgacttcaagtgatccacctgccttggtctcccaaaatgttgggattacaggtgtgagtcaccatgcctggcctgttttcatttttctaaggtggatactttggagttagccgtcattttaaaaatctgcctgtttcaatatttaacattatcagtgggcgctttgctgtgaaagaggaagcagttagctttcttacacttcccccggttattttcttctatccccactatttgttactcaaattatttttcctttgtcagggtttataatatttacattctcttatataaccataaaccatctgtttgttttatctgtttgtttccttttagttttatacttaaaaggattgtatgcttacaaccaggccttataccacaacttctctatttctgatttatttcttggttttctggatttcatcattgaggaggtccttcaagaagagcttgcaggtgctatatttattgtattcttacacgttaagaatgtctgccagctgcctttatacttgaatggtatcttggctggatattatattcttgggccacattttctttccctcagaatgttgtagacattgttccattgtcttcttccattgaatgtaactgtgaagaagtctgaggacatcttggcccttgtctttctttcttatggatgagagagagagagaaagagaaagagaaagggagagagattggacttgcctgaaaattttcttttctttttcttgaagtttagtaatttaagggctgggcacagtggctcactcctgtaatcccagcactttgggaggccaaggtgggcggatcacaaggtcaggagatcgagaccatcccggctaacacggtgaaaccccgtctctaataaaaatacaaaaaaattagccgggcgtggtggcgggtgcctgtagtcccagctgctggggagactgaggcaggagaatggcgtgaacccgcgaggcggagcttgcactgagccaagattgctccactgcactccagcctgggcaacagagcaagactccatctcaaaaaataaaaaataaaaaaaaagtttagtaatttaacaaggttgtaactcaatggtgatcattctgtatcatttttccctatatgtgatatatccttgatgagttctttcttcattgctggaaaatttttctgtatcatgtctcagaactctttttctttctgttttattatttaagttctccacctcagagatactggattttcttatcctctatttttgtcattttcttttactagcgaatggaataggaaaaatggtgaaagcaattaactgtgattagcccaacccattcctccatgctattaatttggttttcagtttatttccctcccctaccccttttcccctcccttccttactttttgctgcttctaatttaattatttgagtaaattatcttatttaggttttgatttgttctttgctctaatcttctttctctcattttgttttatcatcttgtatttgaattcttgcactttattgaatttatattattagttcccctgtagtgtaaagcactcacatgaaacctacttgttttcctagggttaaattcttctccagactcggttcttcatccatcttgcaaattgttttcatttctctccacttcatggctatttatatatctgccagactattatttcattttactgaactttaatatgggaagttttgtctgtatcttttgtttcctctgatatagcatatgtgagttcttctcaccttaacttgaaacaatttatcttttccccattcccagctgtactttagtttaaggactgaatattgctttttatatttctttccttgtaacctgaaggggtaggtgcagaaggcaacttggagtcctgagttttggtctcatgaaattctcttaaatgtcctggttcagggcttacctgtcccagatctgggttaatcccctagctcataccagtgccctgggagatgacattttgcatcagtcttgtctgtctctgttgaggttctacagtggtacctggggctataaatcttgaggacttctgtttttcttgactactcactcacttaatctgcaaattgctacattggaaaggattagttaaggagctttgctgaattaaatcttctgttttcttaggtgcgatttttgaaatctgtgacttgaggctttatttttgactcatttggttgtggcggtgaatttttagcttttgtatggtgtgtgtgtggtttttttttcccctaactttcactcacccaaagggaaatgactttatcatgtttcatatgattgttgaaaaacagcatagaaatgtataaagtaagtcctccagtaacctcactgcttcttccccagataattatcgttaatagttgtgaatagttttggcatatggactaccaagctgtctaaatatacatatatgggttgggttcctaagtttttaatttctttttctttaaaggatgatactataaacatgttaagtgaaaaaaagtgaaagaaaaagaactttaaaaactcaataatacagacaatcccatagaaaatgcacaaaaaatttgaacagacatttcaccaaagacaatatagagatgtcagataagcacatgaaaaggtgctcaacatctttagtcattaaataaatttgacctaaaaatcacaataagatactactacatacccattagaatgactaaaattaaaaagactgaccatgccaattgttggtgaggatgtaaaacaactggatttaaaaaaaattttcttttctacatttcctccttgctattataaacaactagcattcttatacactgctggtgggaatgtacaatggcatagctactttgaaaagcagtttagcagtattttaaaaagttcattgtgcacctaccttgtgattaagtcatttcattcctgggtacttactcaagagaagggaaaacgtatgtttgtacaaagacttctacgtgaatgttcatagcagctttatttgtaatagcccaaccctggaaataacccaaatgctcatcagcaggtgaatggataaactgatttgtttatacggtggaatactactcagcaatggaaagaaatgaactattgatacacgcaataacatgaatgaatctcaaaataatcatgctgagtgaaagaagccaagcagtaaagagtacatactgtatggttctgtttgtataaaaactagaaaatacaaactagaaagcagtgacagaaagcagatcaacacttacaggaagggcaggagggattagaatggggcaggaggaaacctttgggagtgaaagatatgttcattaacttaattgtggtgatagtttcgcagatgtctacatttgtcaaaatgtcacgttgcacacttgaacatgtgcagcttatttatgtcagttattactcaaagcgtaaaagaaaaaaattgtagaaggatataacatgaacatctttctgtgtcagcaccaaggatctgtttcattcttttgacatctgtatgatgtttcattgtatatatggactgtgatttttatctacacagccttgggtgggtgactcatccgttccaggtgatgaggcccccttttttctttgtggattaaggataagaatggcttttatttgctgaacctgattaacacatctgacatcatcagtcagaatgtaatttctgaaacctattgcttctggttgtctgtgatctcttgtctcattggacccagaagactcttatttatcctaaacatgaaaacagattaagtgaccataaatgatctttcccatgaaattatggagcctcagagataatttaattcaaccaccctatttttgcagaaaagaaagcaggataagtgatttacctgagatcatacagatagttagagcccagggctcccatctcttagtctattttttactgcacagatgtcaaataattgcttttctgcccttgggttgtttgtattagctgtggattggtatgtattaatctttaggaaaaaaaggaaaaaccactctccatggaccattgttaaaactacctctctggaggaatggttctgcttgggtttttttggcgggggtgggggtggggacaaaaggggaaaaaggacaattctaaagtaaaaaatgaaatcaagcccccctgctatgtcttgtgctatacaagtaatacatctttcaaggaatgactgacatttcacctcttgtaagtactaggatttcagccctgctgtctgttttcacagaactgtcaaacatcatgtgacaacttggagagtttattctttactggctaagacattatagattttggttacctcattctttgtgcatctattagtttgtttgtttgacaaatatctatgaatgcctactatgtgccaggcattgttttagaccctgagatacactggtgaatacaaggcctcttgtttgtggggcttagatttccggggtgggagataaaaagatagtcaagtaaatgtatggtatatcagatgttgacaggtgctgtggagaaaatgaagtagaccaaaggtatagggagtgccaggaatgaatgtgtgtacatatactgtttaggatagccagggcaagtcttaacaacagggtaacgtttgagcaaagatatgaaaaaaatgagggagcaaacccttagggtatctgggggaagagcatgtagatagagaaagaaggaggtataaagaccctagggtgagattttgtttggcacttttgagtaatctgaaactgagtgagcaagggaggctgaggaaggagttgaggacagagatgggatgagaagcagatcatgttaagactttggtggcacttgtaagcattctgtcttttactccaagtaagaaggatggctctgaggggcacagccttattttgtcttctttttaaaaatggaggtaaagttgacataacataaaatcattttaatcaattttaaagtataaagttctgtgattgttagtactttcagaatgttgtgaaattagatcaccactatctaatttcagaacattttcaccatcccaaatagaaacccgatagccattaagtagccacctccatttaccccagcccctaatatgctttctgtcttgatggatttgcctaatctagacatttcatataaatgcagtcatgcaatatgtggccttttgtgtttggcttatttcaattagcataatgatttcaaagttcatccatgttgcagcatgtatcagaatttcattgtcttttattgatgaataatccattatatgaatataccacatttcatttgtctaatcatgcattgatggacatttaggatgttttcatcttttggctattaggaataatgctgctatgaacattcatgtaacatttttgtgtggacatatattgtttagttctgttgggtaggtacccaggaatggaattgctgggtcatatgatagttctatccctgatttacattttaaaagctcattttggctgttgagggaaagtcaaagccaagggaagaagcaggattagttaggaggctactgcaaccatccaagagctacatgatggtggtttggaccagagtaatggcagtggaggcagtgagaacgtatcagagtctaggtatacattgaagaggatttgctgacagatttgatttgtattgtgagaaaaagaggagtaaccgatgattcttagcgtttttgacttgagaaatgaaagggaattgccatttgatgagacagagcgaagagcagttttgggggaagattagggctttggttttgggcttgctgtgtttgagacatccacgtggagacattgaggaggccattggaaaaacaagtctggagtttgagtaagagataaatttgaggccgggcatgatggctcacgcctgtaatcccaacactttgggaggctgaggcggatggatcacctgaggtcaggagctcaagaccagcctggccaacatggtgaaaacctgtctctactaaaaataaaaaaattagccagccatggtggcacaaacctgtaatcccagctactcaagaggctgaggcaggagatcgcttgaacccaggaggtggaggttgtagtgagccgagattgtgccactgcactccagcctgggtgacagagactccatctcaaaaaacataaaaaataaaaataaatatatttgagttattagtttattgaggatatttaaagccatgagactagatgagatcatttagggataattctagatagagaggaggagcagcccaaggaagaagtttggacataatctaaatattagaggtctacgggaggaggaaggactagcaaaggagactgagaagcagcagccagtgaggttggaggaggaaaccaggagagtgtggtgtccggggagccaagggaagttatttgagatatttgaggaagaatcgatgttttttcccccttttcctgctgctctcactaattctttgaggtaaggggccgaggaaccgtatccttcccttgaaagatgagaactggtattttgaatgcccagagtcatccttcattaaggcgattaagctaaaaaaaagaattctggtcacctgaatactgtcttctagacatactgcttatttatggatatatctcagtcccactgagggcatttattcaataattcagtcaataaaaatacttgagtgcatactctatgctagtctctcttcaaggcactgagaacacatcagtaaataagatacgtggtcactgatcttatggaactttgtcgaatggaggagaaagacattaaataatttgtttaaattattgaaccaaataaataatttgtttaaaatacataaatagttacatatgtggtgactgttactaggaaatcaggatgctatgggagcacagaggaaggttactaatcgagacttagggtgggggcatggccagagagatctggaggaattgacatataaggagagacctgaagcaggagtagattgaggcaggtgaagaaaagtggccattgtgaaaagaatatcttaggcagataaaagagggaagatggagagcttcaggatattcagagaaacaaaataactttgtctttctaaaatataaagcttgaaggaggagtagggggtgaaaaatgagactggagagggtgagcaggggccaaatcatgaggatttcttgccatgctaaggagtttcagctaaatcccaacagcaatggggaaccactgaagagttttaaaagtatactgagggccgggtgtggtggcttacgcctgtaatcccagcactttgggaggccgaggcaggcggatcacgaggtcaggagatcgagaccatcctggctaacacattgaaaccccatctctactaaaaatacaaagaaattagccgggcatggtggcacgcacctgtagtcccagctactcgggaggctgaggcaggagaatggcgtgaacccaggaggcggagcttgcagtgagccaagatcgcgccactgcactccaacctgggagacagagtgagactccgtctcaaaaaaaaaaagtatactcagctgggcaccatggtacatgcctgtactcagctggtacaccatggtacagttactcagaaggctgaggcagcagggttgcttgagcctaggagttagagactgttgtgcactatgatggcacctgtgaatagccacagtactccagcctgggcaacattgcgagaccttatttcttaattaattaatttattatatgtttaaagtatactcatatttattttagaaagatcactcaggctacgattgtgaatggattggaaagaggcctgactagaggcaggagaacctgcttcctttcaatattggctcttggtttttattctagtgtgctatttgaagtgccaaagctgaaaagtggaaagagtgcattggaagctgagagtgagagtctggatagcttcacagctgactcggatagcacctccaggtggggttccccccatttccctcatctcctctcaacccaagttgtgattttgttctgcagcatcagtgttcctgacttctgtcctcaggaagttgaacgaagtattttctctgtcctcaacagaagtcttttcagtagcacgtctactgatttggctctgagcacagcttcctggaacacattgacatctctagtcaattcccccagtatcttggagtattcttcttagcccagtagcaactgatgctgctgtcccttaagaatgagggtgtgagtgtttgtgtttgtgcaaagttgcctatctgatcttctgcattccttccaggtaaatcacatgcgaagtgtaccttctgaatttggttattacgatgacccaagccattggctctccttccatagagctttgatccctgggtagaaggggaagggtaggaggtgacttagttataatttctgaatctacctccaggagagactctctggataaatctggcctctttccagaatggaagaagatgtctgctcccaaatctcaagtagaaaaggtaagcttcaggttattgagccaccttcctcccctcccttccttccctttctcctttacctcctgtctccctccgtctttccctccctccctccccctcactcttctcttcctctttcttccctccctccctccattctcttaggcagaatttaaatcaggaatttcaactaaacaaatttcagttcaaattcacttgggagcattttctgaagttttgtttgaaatgtgtgagaaaataggttttgtactatttctaggcatttaatctttcctttaagtttgtcatagtttagcgaaaatctgagccttattcttcttaagactgtccttccttactcactccttctacctatccatctgttcttttccattttcttgcccttgttccttcctaggaaactcagcctggaggtcaaaatgtggtatttgtggatgagggtgagatgatatttaagaagaacaccagaaaaatcctcaggccttcaggtaactggtttcccttactggtctttcaggactgaagttctgagtacccttgatgggctcttggtatggagaagaataggtctctttgatttggcttttttggtcttcccctcagagtacactaaatctgtgatagatcttcgcccagaagatgtggtacatgaaagtggctccttgggagacagaagcaaatccgtcccaggcctcaatgtggatatggtaggtgcccttatattttacttggtcactatatgaaattttacttatctggagttggctttagtacctgatattctcagtcaacctatttaattctttaagaaaaggcaacatgaaacttgatacccccaagtttctaaagtaaatctggttcctgatttgcttaaaggaaaggactgtctttgctatctcttttttttttttttttttttttttgagacggagtttcgctcttgtttctcaggctggagtgcaatggcacgatctcggctcactgcaacctccgcctcctgggttcaagcagttctcctgcctcagcctcctgagtagctgggattacaggtgtgcgccaccatgcctgggtaattttttatatttttagtagatatggggtttcaccatgttggccaggctggtcgcaaactcctgacctcaggtgatccacctgcctcggcctcccaatttttttttttttttttaagagacagcatctcactctgtttcccagactggagtgtagtggtacaattatagctcagtgccaccttgaactcctgagctcaagctgtcctcccacctcagcctcctgagtagctgggactataggcatgaaccatcatacccagctaattttttttttttttttgagagatgggagtctcactgtatttcccagcctggtcttgaactcctaggctcaagtgatccgcccgcctctgcctcccaaagtgctggaattacaggcatgagccatcacgcctgaccatctcttttattttctaataaattgctggatatatggctggggctcaaataaatacttcttttgattaaaatgtaaacagggttggggaaagtcaaatggaaaagagttatagcttctatgaaaaacattaaatattcttatcttattcttttgagatatgagaaggatggttggaatagagctgggaaccctgaaatgggaagacatgtaaaaagaaggatatgaggccaggcatggtggctcatgcctgtaatctcagcactttgggaggccgaggcaggcggatcacctgagatcaggagtttgagaccagcctggccatcatggagaaaccctgtctctactaaaaatacaaaaattagccaggtgtggtggcgggtgcctgtaatcccagctactctggaggctgaagcaggagaattgcttgaacccaggaggcggaggttgcggtgagctgagattgcgccattgccctccagcctgggcaacaagagtgagactccgtctcaaaaaaaaaaaaaaaaaagaagtatgtgtgcgtacacatacacatggcaacttggagctttaaaggaaagatattagtctttgaagctaaagaaaagtctttcttttattaactctgaatttatatttattgttccaggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcctgagcccccacctggagattattacattacagcttgggacatttttcatcacagctttgtgaacaataaccttaacttatcctctaaaggggtacccaggctatgaagtgagcaagatcagatttcttcatcatagcccattccaaattctcaacattaaaagaaagtgagtgtcatgagaggggctctggcagggttgatcgacatcagggtatggttaacaagcaataataccagtcaggataatgaatttaaagggaacatttaagaatcagggcctggttctgtcataagcatgaagattgatatttagggaaacaggaacaagggtgaacagaatttgttcacactcacacacaggaagagaatgtcagctcgcatgaccgattactaccagaaaggaaggtgccttttcacttctggtggggtttcctccctcccactcactcccagttctggccaaatctcttttctctgtaggccctgataagacataaggtggataagagaaacccacagataattaaggcaccttgttttagttagtaactaacccccttctagctggtgttttagtgtatataacacattccccagatggacttaactgcaccttgcctctgctccctgcccacctcctggggcaggtgaaaatgaacactaaaatttgtaaaaagagttgaggaagagaagctaagaggctaggtgagccatgagctgattcattcacctgaacaattttgagtgctggtagttctctcttaccctctgggtcaaggaatgtcagcagcactggcttattgcaggggcttctgaaacttctgttcagtgactgtggttttatcatgagggaagatgtgagcaatgcgggcgggggagtgtgccttccccagatgttcgtgggtgctttatcttcagagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccgtgagtgcttctggaacctgactgatgctctgagaccagagaccagaccccggcatctgtccgggcactcttgaacagagcttatctgtttctgggggagcagggaggtgtaatgtaggaaaagaaccaggattgggaaaaagcaagaatggcatgtctaagagggcttgaggtgacatttttgacatcacatgtcaccatggcatatctatatggagaggaggaaagtgaaaagcaggcttgagaaaggccagcaaattactcagtgctgtctttggtttctagatatgtgaagacttaccttctgcctgacaagtcccgccaaggaaaaagaaaaaccagcatcaagcgggacactattaatccactatatgatgagacgctgagggtaagtatctagacctcaagggtaggagaacttgttctgtcttgtgccctaagctgtagctattcctctgcaacatgaccaggtgacacgggcttcagtgggccatgtctgtgtctgaggatacattgggtatctgttcacatcctgatctcccagtgaagagaacaaaggtgatctgcctttcctggattgatgtgaagtttgagattcacatggccacaaatctcatgtaaaaaagacatttgagataaggagtctccttggcagttctttttggacaatccagtgttatctcatccacttaagaaaaaatgaattttccaggtcctcctatggaatatggtaggtttttataaaatgagttaagttgaggctttgagtgaggaaactcaaagtgctcagggaacataaagtaatttggtattcaggactagtgacttcaggaatggttgctcaggttttggaataatcttgtctgaagaattacccttaactaatcatcttgggcttttactttcccttcacagtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaaggtagtctgctttaacaactcctgcagtttggatctgaggtagaattgtctgcagtagcctctgctggtctatgttggtagcgtctttgaatgtagtcttctctggagttctagtgccccctgctggtgtttctgagtttgacagcaatttcagaggcatttgtctatcaagtgtgagttctgtgtaaaccaggcaaagtgtgaagccatggttttgctttgaaaaaattttcatatgtgtaccaaactttgtctcctaaccttccagaatctgggtgtatcctaacatcctaactcgcacctcttctccgagctaaccttctgtgtatatcctaatctgtacccttttgccaagccactgctttacttccaagtgggaagtaaagcaattcatggagctccaattgctatgctcttggttacagaggccagggaaatattactttggagatggcacctcgggccacagtgtagcagtatggcataatcatgcctgggatctgagtgcagacctgtgttggaatcctggttctgtcacttgccaactagatgagtcacttaactacaaaataatgtagggaaatcatctggctaagaagaaatagctaaaacagaggacttattcagcaacttcttgattatcagaactacacaatgacatgacaaagttcatcttatttttttttacactagcgttttaaatgtgggatggttttacatggtccatagactttgggaagttagatgagaaactagtcatggtggctgcctctaggaatggagactgaggtagaaggaatatttagttttctctatatcccctttttaagcatttgaactttttaccatattaagaaaattaagcaaaaatggacttatgtacacatgattcaaaattaaaacaacataaagtatattaaaaggaaagtaggttccattccttagaaataaccagtgttaacactacttgtgtatccttctagaaattttttatggctaggtatggtggctcacgcctgtaatcccagcacattgggaggcggaggcaggcagatcacctgaggtcaggagttcgagaccaccctgaccaacatggtgaaaccccgtctctactaaatacaaaaaaattagctgggcatggtggcgcaagcctgtaatcccagctacttgggaggctgaggcaggagaatcgcttgaacccatgaggcggaggttgcagtgagccgagattgcgcctttgcactccagcctgggcaaaagagtgaaactctgtctcaaaaaaaaaaaaaaaaaa

SEQ ID NO: 5771 - DNA, 708 bp, human
gggagggtgagaagggccggctgccggagctgggttgcgatcttcccggagccggagaccctcccttgaaaccggcactgggacttctcgatctctggaggcacctgttgcaagtgacaggtaggtcaacagccagcggccggcccctcgccctcggtccggtgctccttctggacccccagctccttttcgctgctgaagcgcccccacccccatctcggggtcgtgcgtcttccctacccgctctctggtcccccaatttttccttctccctagctgaccgcgtctcccctctccccgtccgcctctcccgaccgcatccccaggcttggactcccgtctgcttgggcggtccctcccggccacttttctttctccagggcttcttctggccccttccctgacccacccagcactaatgcggtctgtgcccctctgggagccgcctcccctctcctcttcggctcccctcgcggggagtgcccgggcttttcccgccagcccgagctggtgcccctcccgagagctggccctgggggcgggggcggggccgagctcctagcgggaactgcgccctccaaggcgtccagtcaccttttcgtgggttcctctcacagcgctcggccgtcgagcggggtcgctaacccgcactctcttcggacctacgacatcgcggcttctctggcgttggccagtcagccacaggta

SEQ ID NO: 5772 - DNA, 1737 bp, human
gctgtgcgctctggggcacctcatgcagacgggagtagggaggctgttttttgcgcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtaagggctccggggcccgtgagccccggccatgccagcagcggctgaccgacctcggcgacaggcgcagaacagcgcagggggtccccgccagctttctccacaccccaacatgcttgggaacacagaggcccccagggatggggaagcaggggcggctgggtttccaggggcggcagagccaccaagagcgatggaaacccacccccgagtccctgcaggaaaacagcgaacaccgcggggggctgggcgttcgagggtggggtgggggtggggggcgggagacgcggggcgctggcagcgaggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggtcggtgcgagggacggtggtggggcgggggtcggaacgtaaggaaagcccagtctgagaccccaaccccctccaccccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 5773 - DNA, 1682 bp, human
cgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtaagggctccggggcccgtgagccccggccatgccagcagcggctgaccgacctcggcgacaggcgcagaacagcgcagggggtccccgccagctttctccacaccccaacatgcttgggaacacagaggcccccagggatggggaagcaggggcggctgggtttccaggggcggcagagccaccaagagcgatggaaacccacccccgagtccctgcaggaaaacagcgaacaccgcggggggctgggcgttcgagggtggggtgggggtggggggcgggagacgcggggcgctggcagcgaggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggtcggtgcgagggacggtggtggggcgggggtcggaacgtaaggaaagcccagtctgagaccccaaccccctccaccccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 5774 - DNA, 1653 bp, human
ggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtaagggctccggggcccgtgagccccggccatgccagcagcggctgaccgacctcggcgacaggcgcagaacagcgcagggggtccccgccagctttctccacaccccaacatgcttgggaacacagaggcccccagggatggggaagcaggggcggctgggtttccaggggcggcagagccaccaagagcgatggaaacccacccccgagtccctgcaggaaaacagcgaacaccgcggggggctgggcgttcgagggtggggtgggggtggggggcgggagacgcggggcgctggcagcgaggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggtcggtgcgagggacggtggtggggcgggggtcggaacgtaaggaaagcccagtctgagaccccaaccccctccaccccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagca

SEQ ID NO: 5775 - DNA, 1155 bp, human
aggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggtcggtgcgagggacggtggtggggcgggggtcggaacgtaaggaaagcccagtctgagaccccaaccccctccaccccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagc

SEQ ID NO: 5776 - DNA, 883 bp, human
ccccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaattt

SEQ ID NO: 5777 - DNA, 12568 bp, human
gaactttctggaaaattaacagtgcgtatttgcctgaagaaggtcagtgtgcttgcttggagatcaggacgcaaaggtaagagcgcctcagtcgccacagaaatccggagtccctaacggaggggaaggctgtcgtagatagatattctcacaggaaaattgtatttgtgccaagagaactgcacgcaaccttgaagggagggggtaggtgtggaggaggggagggaggacgatactagagaacttgaaagaagcctccctttggagttgctaatgcggcgatggaagggtttggctctgaatcattggagggctgtggtttacgataggattttggcacggaggaaaacgtaggaagtgtatttttaaagtaattaaatcagtacggaaagccaaaatatttctgacagtgcccctttatctgttattgtcgcctttccttaattatttattttccttttcattagaacattttcaaatataacacagaaatagataacaacctgcgcgcagtagcaaacccctccctgcaccgcccccaccatcacgcacgcgcgcgcgcccgccgtggctctcaccagtcccgacgccaggggcgcacgcctgcgcaaacacagcacctcccgagccacgagggccgctcacacagcaaccccagcaccacgcgagcctgcccgcgcactaacacactggccttaatgccttgcgcccgttgcactcacgaccctcacttgcaaacacagcagaacccccactgcgccttttttttccgtgttcggggagttgcgccacaggactgggggcgtggccccagatttgacctcgcgcttccccactcgcgggaaccttagctcatttccgcctatcctatttccgcaggccacgtagacacttcctctcccagtggggggggaaaaaaaccacaaacccataatgcctccctgcaggaaaaaaaaaaaaaaggaaaaggaaaaaaaaaaaccctctggtcagaggaactctgggtcgtgaaataggccacgtgaacattctgccctgtagacttatgacccaacggctgtcacgcttttggagggcgggctaaaaaaaaaaacctaagagggcgaacgtcattggccggaactcgtactaacggaggaagaggattggtttgctgtagaccttaacagtgaagaagcaggttgctagcacccgcctttactgcggcgaagtgtcattgctgacgtgggggtggttgtccaatcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaaaaaaaaatctattacatgtaatggaaatgtttcaagatccagaagagaaaattgatatgaatgtaactgatatggtatatgtgcatttaaaggtttattccaacaaaatgttactcacactcttttctgacacatgcatacacaaaagatgttagcatttgcagtctgattcccaaatggcccattgcttgtgtggagagatgaagtaggatttgaaggtttttcagccttttgacagctacatatggagtcactgtaatttccttttttttctctcttctgaaaagtaggtttcggaggagggcactgccctcctggaagagatgcattagatcggtaggcacagaatacctttacatgagaccatttagagaatgattaggggccaaaggtaaggggtggactgttaagccaacagggactcagagaaagcaagggtcagggtgaccagaaatagagaaaaaaaagcctcacagaggaagaggacctggacctgagccacagaggatgggtagaacttagaaggagggaatgagcccagtctgaatgatatgtctacaaagtatacaatatgcaatgatgattaactgaaaaattgggctggccatttgtgagatccatgaataaaagtagatcagaaagtcagtgtgagttttaaatatatatattttattataaaacgttaatcacataatatgtgaaatcactattgataaccttttctattggtcctagtgttttgctatttaagataatactgcatcaaatattcttagtgtagccatccatttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaagaaaaaaaaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaaaagtcgctctcctttttttttcaaaaagatgtttttccagtgttcttgaagtcatgaaaaaatgaacttttatatttttgttaggagtacaaattaaaacagttctttgtgaggtgaatttggctctatctcatcaaagttataaataagcaaatcctttcgctaaatagttcctcttggaatatatccttcagaggtacttaactaatgctctaatatttgtatacactgatgtgcattgcagtatttttgtaataatgaaatattgggaacaacctaaatgttcagagactggttatagtacataacattatagaatgtgttatgaatattaaaaagaagaggtaggtatgtactgacatggaaagatgcctatgagaagtgagcaaagcaaggtgcagagcagtatggatctcacctttgtcaaaacaaattaaataaatgcatgctatatattcacatacctatgtgtataatatacacattgagtctttaaagttacattttatgtgaatgtacatgaaaagatttgaaggcatacatgctcactcaggatactcctaggattggggtgggagagggggaggtgataagggaagaatgttcacatctttatataatttgttatctatagttataaaaaggaaatataaatggtaccacaagatctaattacttgaggtgaacgaagattgtcagttcatgacttgcaaactactagatggattaaggagttataaaagaaatctatcaaagtatttgttcttaatttttaaacttaaaaatgaaaggaaaaaaaattttttaaatgatccccagtactggtcagagcatgaggcatagtaaatatttttacacactgcttgtgggattagaaattggcacaacttgtgcagagggagtaatttggcagtgtattgagagtgttctatctcttgactcactaagcccgcttctgagagtcttaaaggaacaaaaggaagcgagagcaaaaaaatgtttacacaaaatgttttcattgattattaaagaatatattggtgggaggtgtgcactggatatttccagggaaggagtggctaagtaaattaaggtatgctcatttgacagaatatctattatatgactcaaaatggatgcatataataaccttaacatgggaagattattggttatcatagtaaattttttaaaaggaaaaatctaagatttgatagcccttatgagctcacctctgtttaaatgtattatttatacagagattaaactggtgtaaaattaaagatagaaaactaagacaaacataagtacaaatgtgttttctgaatttctggcttaccctagagctgacctgtagggaacaggtggcaaaatagttggtgactgttgtccctaatttgtgccctcattttctccatgtgttgagtcacagccccctccaccccaattcacaattatatacccaccagggaccaatgtgacttccagaatggtttttgtccagcttggctctacttaatgtgttttacacagtctggttggcactaggtcatgttgctttctttaggtggtattttcactatcatccctttgttttatggaacctctgcactatgagccccaagatgggctttctggatttactcatgcaggttcagtaaccctaatctgaaatgctccaaaatctgaaactttctgagtgccaacatgccactagtagatgattccacatctgacctcatgtgacaggtgcaaagaaatgtttaaaatactgtataaaattaccttcaagaccatgtgtataaggtgtatatgaaacataaatgaatttcctgtttagactggggtcccatccccaagatattctcacacatatgcaaatattccaatatctgaaacacttctcatcccaagcattttggataaggaatactcaacctgtattaacaattctctgaagtcttcagatactgtatctggtctgtcctggtcacaaagcaattcttttagaaacattattctggaagcatgatagcttacaatttaatgccatgatacagtggccactatcaccactgtctgatccttcacaggatgtgtctccgtgtccctctcagccagaaggtttctgattcccacagggatcagtctccatatttacaaattttgatgctttctgaagactgactttacccttgaatttctgctcaaagctttgtgctttttcagttagaggatattgtttgcttagtgaaagtactagcatccaggcctttcttcccaataactggctttcctggttcagggatctagtcttcaagcatgcatgcatgcatatttatttatttgtttgtttgtttgacagagtctcactgtcacccaggctggagtgcagtggcacgatctcctggctcactgcaacctccatctcccaggttcaagtgattctcctgcctcagcctcccaagtagctgggattataggtgtgcaccactaagcctggctaatttttgtgtttttagtagggacagggtttcaccatgttggccaggctggtcttgaactcctgacctcaagagatttggccacctcggccacccaaaatgctgggattacaggcgtgagccaccgtgcccggccttgttttcttttcttttctttttttttttttttttttttttttgcccacaggtgctactaacaaacatttcttatctctgattttcttctcagagcctccctgacacctgcctacagtgttaatggctacagaatggctgctgggctttttctgtgggtgaaagttgtagttactagagaaacctggtttaaggctagtctacaatcatccctttctcagaggttaccctgattttaacaggctgatatttatctgtctagatatttccatgcatatttatagacatctgtttaaaacacacacacaaatgacagcacactcttcctaaaaactatttcacactaatgcttatttctctacctgtactatctttttttttttggagatggagtctctgtcgcccaggctagagtgcagtggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaag

SEQ ID NO: 5778 - DNA, 12658 bp, human
aaaatcccagaatcccagggaccaaacagccaatcctttgctgggatttggcggcatctagtggcagactcgagaggtataaaccttactcacagaactttctggaaaattaacagtgcgtatttgcctgaagaaggtcagtgtgcttgcttggagatcaggacgcaaaggtaagagcgcctcagtcgccacagaaatccggagtccctaacggaggggaaggctgtcgtagatagatattctcacaggaaaattgtatttgtgccaagagaactgcacgcaaccttgaagggagggggtaggtgtggaggaggggagggaggacgatactagagaacttgaaagaagcctccctttggagttgctaatgcggcgatggaagggtttggctctgaatcattggagggctgtggtttacgataggattttggcacggaggaaaacgtaggaagtgtatttttaaagtaattaaatcagtacggaaagccaaaatatttctgacagtgcccctttatctgttattgtcgcctttccttaattatttattttccttttcattagaacattttcaaatataacacagaaatagataacaacctgcgcgcagtagcaaacccctccctgcaccgcccccaccatcacgcacgcgcgcgcgcccgccgtggctctcaccagtcccgacgccaggggcgcacgcctgcgcaaacacagcacctcccgagccacgagggccgctcacacagcaaccccagcaccacgcgagcctgcccgcgcactaacacactggccttaatgccttgcgcccgttgcactcacgaccctcacttgcaaacacagcagaacccccactgcgccttttttttccgtgttcggggagttgcgccacaggactgggggcgtggccccagatttgacctcgcgcttccccactcgcgggaaccttagctcatttccgcctatcctatttccgcaggccacgtagacacttcctctcccagtggggggggaaaaaaaccacaaacccataatgcctccctgcaggaaaaaaaaaaaaaaggaaaaggaaaaaaaaaaaccctctggtcagaggaactctgggtcgtgaaataggccacgtgaacattctgccctgtagacttatgacccaacggctgtcacgcttttggagggcgggctaaaaaaaaaaacctaagagggcgaacgtcattggccggaactcgtactaacggaggaagaggattggtttgctgtagaccttaacagtgaagaagcaggttgctagcacccgcctttactgcggcgaagtgtcattgctgacgtgggggtggttgtccaatcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaaaaaaaaatctattacatgtaatggaaatgtttcaagatccagaagagaaaattgatatgaatgtaactgatatggtatatgtgcatttaaaggtttattccaacaaaatgttactcacactcttttctgacacatgcatacacaaaagatgttagcatttgcagtctgattcccaaatggcccattgcttgtgtggagagatgaagtaggatttgaaggtttttcagccttttgacagctacatatggagtcactgtaatttccttttttttctctcttctgaaaagtaggtttcggaggagggcactgccctcctggaagagatgcattagatcggtaggcacagaatacctttacatgagaccatttagagaatgattaggggccaaaggtaaggggtggactgttaagccaacagggactcagagaaagcaagggtcagggtgaccagaaatagagaaaaaaaagcctcacagaggaagaggacctggacctgagccacagaggatgggtagaacttagaaggagggaatgagcccagtctgaatgatatgtctacaaagtatacaatatgcaatgatgattaactgaaaaattgggctggccatttgtgagatccatgaataaaagtagatcagaaagtcagtgtgagttttaaatatatatattttattataaaacgttaatcacataatatgtgaaatcactattgataaccttttctattggtcctagtgttttgctatttaagataatactgcatcaaatattcttagtgtagccatccatttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaagaaaaaaaaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaaaagtcgctctcctttttttttcaaaaagatgtttttccagtgttcttgaagtcatgaaaaaatgaacttttatatttttgttaggagtacaaattaaaacagttctttgtgaggtgaatttggctctatctcatcaaagttataaataagcaaatcctttcgctaaatagttcctcttggaatatatccttcagaggtacttaactaatgctctaatatttgtatacactgatgtgcattgcagtatttttgtaataatgaaatattgggaacaacctaaatgttcagagactggttatagtacataacattatagaatgtgttatgaatattaaaaagaagaggtaggtatgtactgacatggaaagatgcctatgagaagtgagcaaagcaaggtgcagagcagtatggatctcacctttgtcaaaacaaattaaataaatgcatgctatatattcacatacctatgtgtataatatacacattgagtctttaaagttacattttatgtgaatgtacatgaaaagatttgaaggcatacatgctcactcaggatactcctaggattggggtgggagagggggaggtgataagggaagaatgttcacatctttatataatttgttatctatagttataaaaaggaaatataaatggtaccacaagatctaattacttgaggtgaacgaagattgtcagttcatgacttgcaaactactagatggattaaggagttataaaagaaatctatcaaagtatttgttcttaatttttaaacttaaaaatgaaaggaaaaaaaattttttaaatgatccccagtactggtcagagcatgaggcatagtaaatatttttacacactgcttgtgggattagaaattggcacaacttgtgcagagggagtaatttggcagtgtattgagagtgttctatctcttgactcactaagcccgcttctgagagtcttaaaggaacaaaaggaagcgagagcaaaaaaatgtttacacaaaatgttttcattgattattaaagaatatattggtgggaggtgtgcactggatatttccagggaaggagtggctaagtaaattaaggtatgctcatttgacagaatatctattatatgactcaaaatggatgcatataataaccttaacatgggaagattattggttatcatagtaaattttttaaaaggaaaaatctaagatttgatagcccttatgagctcacctctgtttaaatgtattatttatacagagattaaactggtgtaaaattaaagatagaaaactaagacaaacataagtacaaatgtgttttctgaatttctggcttaccctagagctgacctgtagggaacaggtggcaaaatagttggtgactgttgtccctaatttgtgccctcattttctccatgtgttgagtcacagccccctccaccccaattcacaattatatacccaccagggaccaatgtgacttccagaatggtttttgtccagcttggctctacttaatgtgttttacacagtctggttggcactaggtcatgttgctttctttaggtggtattttcactatcatccctttgttttatggaacctctgcactatgagccccaagatgggctttctggatttactcatgcaggttcagtaaccctaatctgaaatgctccaaaatctgaaactttctgagtgccaacatgccactagtagatgattccacatctgacctcatgtgacaggtgcaaagaaatgtttaaaatactgtataaaattaccttcaagaccatgtgtataaggtgtatatgaaacataaatgaatttcctgtttagactggggtcccatccccaagatattctcacacatatgcaaatattccaatatctgaaacacttctcatcccaagcattttggataaggaatactcaacctgtattaacaattctctgaagtcttcagatactgtatctggtctgtcctggtcacaaagcaattcttttagaaacattattctggaagcatgatagcttacaatttaatgccatgatacagtggccactatcaccactgtctgatccttcacaggatgtgtctccgtgtccctctcagccagaaggtttctgattcccacagggatcagtctccatatttacaaattttgatgctttctgaagactgactttacccttgaatttctgctcaaagctttgtgctttttcagttagaggatattgtttgcttagtgaaagtactagcatccaggcctttcttcccaataactggctttcctggttcagggatctagtcttcaagcatgcatgcatgcatatttatttatttgtttgtttgtttgacagagtctcactgtcacccaggctggagtgcagtggcacgatctcctggctcactgcaacctccatctcccaggttcaagtgattctcctgcctcagcctcccaagtagctgggattataggtgtgcaccactaagcctggctaatttttgtgtttttagtagggacagggtttcaccatgttggccaggctggtcttgaactcctgacctcaagagatttggccacctcggccacccaaaatgctgggattacaggcgtgagccaccgtgcccggccttgttttcttttcttttctttttttttttttttttttttttttgcccacaggtgctactaacaaacatttcttatctctgattttcttctcagagcctccctgacacctgcctacagtgttaatggctacagaatggctgctgggctttttctgtgggtgaaagttgtagttactagagaaacctggtttaaggctagtctacaatcatccctttctcagaggttaccctgattttaacaggctgatatttatctgtctagatatttccatgcatatttatagacatctgtttaaaacacacacacaaatgacagcacactcttcctaaaaactatttcacactaatgcttatttctctacctgtactatctttttttttttggagatggagtctctgtcgcccaggctagagtgcagtggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaag

SEQ ID NO: 5779 - DNA, 11543 bp, human
tatttgcctgaagaaggtcagtgtgcttgcttggagatcaggacgcaaaggtaagagcgcctcagtcgccacagaaatccggagtccctaacggaggggaaggctgtcgtagatagatattctcacaggaaaattgtatttgtgccaagagaactgcacgcaaccttgaagggagggggtaggtgtggaggaggggagggaggacgatactagagaacttgaaagaagcctccctttggagttgctaatgcggcgatggaagggtttggctctgaatcattggagggctgtggtttacgataggattttggcacggaggaaaacgtaggaagtgtatttttaaagtaattaaatcagtacggaaagccaaaatatttctgacagtgcccctttatctgttattgtcgcctttccttaattatttattttccttttcattagaacattttcaaatataacacagaaatagataacaacctgcgcgcagtagcaaacccctccctgcaccgcccccaccatcacgcacgcgcgcgcgcccgccgtggctctcaccagtcccgacgccaggggcgcacgcctgcgcaaacacagcacctcccgagccacgagggccgctcacacagcaaccccagcaccacgcgagcctgcccgcgcactaacacactggccttaatgccttgcgcccgttgcactcacgaccctcacttgcaaacacagcagaacccccactgcgccttttttttccgtgttcggggagttgcgccacaggactgggggcgtggccccagatttgacctcgcgcttccccactcgcgggaaccttagctcatttccgcctatcctatttccgcaggccacgtagacacttcctctcccagtggggggggaaaaaaaccacaaacccataatgcctccctgcaggaaaaaaaaaaaaaaggaaaaggaaaaaaaaaaaccctctggtcagaggaactctgggtcgtgaaataggccacgtgaacattctgccctgtagacttatgacccaacggctgtcacgcttttggagggcgggctaaaaaaaaaaacctaagagggcgaacgtcattggccggaactcgtactaacggaggaagaggattggtttgctgtagaccttaacagtgaagaagcaggttgctagcacccgcctttactgcggcgaagtgtcattgctgacgtgggggtggttgtccaatcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaaaaaaaaatctattacatgtaatggaaatgtttcaagatccagaagagaaaattgatatgaatgtaactgatatggtatatgtgcatttaaaggtttattccaacaaaatgttactcacactcttttctgacacatgcatacacaaaagatgttagcatttgcagtctgattcccaaatggcccattgcttgtgtggagagatgaagtaggatttgaaggtttttcagccttttgacagctacatatggagtcactgtaatttccttttttttctctcttctgaaaagtaggtttcggaggagggcactgccctcctggaagagatgcattagatcggtaggcacagaatacctttacatgagaccatttagagaatgattaggggccaaaggtaaggggtggactgttaagccaacagggactcagagaaagcaagggtcagggtgaccagaaatagagaaaaaaaagcctcacagaggaagaggacctggacctgagccacagaggatgggtagaacttagaaggagggaatgagcccagtctgaatgatatgtctacaaagtatacaatatgcaatgatgattaactgaaaaattgggctggccatttgtgagatccatgaataaaagtagatcagaaagtcagtgtgagttttaaatatatatattttattataaaacgttaatcacataatatgtgaaatcactattgataaccttttctattggtcctagtgttttgctatttaagataatactgcatcaaatattcttagtgtagccatccatttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaagaaaaaaaaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaaaagtcgctctcctttttttttcaaaaagatgtttttccagtgttcttgaagtcatgaaaaaatgaacttttatatttttgttaggagtacaaattaaaacagttctttgtgaggtgaatttggctctatctcatcaaagttataaataagcaaatcctttcgctaaatagttcctcttggaatatatccttcagaggtacttaactaatgctctaatatttgtatacactgatgtgcattgcagtatttttgtaataatgaaatattgggaacaacctaaatgttcagagactggttatagtacataacattatagaatgtgttatgaatattaaaaagaagaggtaggtatgtactgacatggaaagatgcctatgagaagtgagcaaagcaaggtgcagagcagtatggatctcacctttgtcaaaacaaattaaataaatgcatgctatatattcacatacctatgtgtataatatacacattgagtctttaaagttacattttatgtgaatgtacatgaaaagatttgaaggcatacatgctcactcaggatactcctaggattggggtgggagagggggaggtgataagggaagaatgttcacatctttatataatttgttatctatagttataaaaaggaaatataaatggtaccacaagatctaattacttgaggtgaacgaagattgtcagttcatgacttgcaaactactagatggattaaggagttataaaagaaatctatcaaagtatttgttcttaatttttaaacttaaaaatgaaaggaaaaaaaattttttaaatgatccccagtactggtcagagcatgaggcatagtaaatatttttacacactgcttgtgggattagaaattggcacaacttgtgcagagggagtaatttggcagtgtattgagagtgttctatctcttgactcactaagcccgcttctgagagtcttaaaggaacaaaaggaagcgagagcaaaaaaatgtttacacaaaatgttttcattgattattaaagaatatattggtgggaggtgtgcactggatatttccagggaaggagtggctaagtaaattaaggtatgctcatttgacagaatatctattatatgactcaaaatggatgcatataataaccttaacatgggaagattattggttatcatagtaaattttttaaaaggaaaaatctaagatttgatagcccttatgagctcacctctgtttaaatgtattatttatacagagattaaactggtgtaaaattaaagatagaaaactaagacaaacataagtacaaatgtgttttctgaatttctggcttaccctagagctgacctgtagggaacaggtggcaaaatagttggtgactgttgtccctaatttgtgccctcattttctccatgtgttgagtcacagccccctccaccccaattcacaattatatacccaccagggaccaatgtgacttccagaatggtttttgtccagcttggctctacttaatgtgttttacacagtctggttggcactaggtcatgttgctttctttaggtggtattttcactatcatccctttgttttatggaacctctgcactatgagccccaagatgggctttctggatttactcatgcaggttcagtaaccctaatctgaaatgctccaaaatctgaaactttctgagtgccaacatgccactagtagatgattccacatctgacctcatgtgacaggtgcaaagaaatgtttaaaatactgtataaaattaccttcaagaccatgtgtataaggtgtatatgaaacataaatgaatttcctgtttagactggggtcccatccccaagatattctcacacatatgcaaatattccaatatctgaaacacttctcatcccaagcattttggataaggaatactcaacctgtattaacaattctctgaagtcttcagatactgtatctggtctgtcctggtcacaaagcaattcttttagaaacattattctggaagcatgatagcttacaatttaatgccatgatacagtggccactatcaccactgtctgatccttcacaggatgtgtctccgtgtccctctcagccagaaggtttctgattcccacagggatcagtctccatatttacaaattttgatgctttctgaagactgactttacccttgaatttctgctcaaagctttgtgctttttcagttagaggatattgtttgcttagtgaaagtactagcatccaggcctttcttcccaataactggctttcctggttcagggatctagtcttcaagcatgcatgcatgcatatttatttatttgtttgtttgtttgacagagtctcactgtcacccaggctggagtgcagtggcacgatctcctggctcactgcaacctccatctcccaggttcaagtgattctcctgcctcagcctcccaagtagctgggattataggtgtgcaccactaagcctggctaatttttgtgtttttagtagggacagggtttcaccatgttggccaggctggtcttgaactcctgacctcaagagatttggccacctcggccacccaaaatgctgggattacaggcgtgagccaccgtgcccggccttgttttcttttcttttctttttttttttttttttttttttttgcccacaggtgctactaacaaacatttcttatctctgattttcttctcagagcctccctgacacctgcctacagtgttaatggctacagaatggctgctgggctttttctgtgggtgaaagttgtagttactagagaaacctggtttaaggctagtctacaatcatccctttctcagaggttaccctgattttaacaggctgatatttatctgtctagatatttccatgcatatttatagacatctgtttaaaacacacacacaaatgacagcacactcttcctaaaaactatttcacactaatgcttatttctctacctgtactatctttttttttttggagatggagtctctgtcgcccaggctagagtgcagtggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatg

SEQ ID NO: 5780 - DNA, 11544 bp, human
gcgtatttgcctgaagaaggtcagtgtgcttgcttggagatcaggacgcaaaggtaagagcgcctcagtcgccacagaaatccggagtccctaacggaggggaaggctgtcgtagatagatattctcacaggaaaattgtatttgtgccaagagaactgcacgcaaccttgaagggagggggtaggtgtggaggaggggagggaggacgatactagagaacttgaaagaagcctccctttggagttgctaatgcggcgatggaagggtttggctctgaatcattggagggctgtggtttacgataggattttggcacggaggaaaacgtaggaagtgtatttttaaagtaattaaatcagtacggaaagccaaaatatttctgacagtgcccctttatctgttattgtcgcctttccttaattatttattttccttttcattagaacattttcaaatataacacagaaatagataacaacctgcgcgcagtagcaaacccctccctgcaccgcccccaccatcacgcacgcgcgcgcgcccgccgtggctctcaccagtcccgacgccaggggcgcacgcctgcgcaaacacagcacctcccgagccacgagggccgctcacacagcaaccccagcaccacgcgagcctgcccgcgcactaacacactggccttaatgccttgcgcccgttgcactcacgaccctcacttgcaaacacagcagaacccccactgcgccttttttttccgtgttcggggagttgcgccacaggactgggggcgtggccccagatttgacctcgcgcttccccactcgcgggaaccttagctcatttccgcctatcctatttccgcaggccacgtagacacttcctctcccagtggggggggaaaaaaaccacaaacccataatgcctccctgcaggaaaaaaaaaaaaaaggaaaaggaaaaaaaaaaaccctctggtcagaggaactctgggtcgtgaaataggccacgtgaacattctgccctgtagacttatgacccaacggctgtcacgcttttggagggcgggctaaaaaaaaaaacctaagagggcgaacgtcattggccggaactcgtactaacggaggaagaggattggtttgctgtagaccttaacagtgaagaagcaggttgctagcacccgcctttactgcggcgaagtgtcattgctgacgtgggggtggttgtccaatcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaaaaaaaaatctattacatgtaatggaaatgtttcaagatccagaagagaaaattgatatgaatgtaactgatatggtatatgtgcatttaaaggtttattccaacaaaatgttactcacactcttttctgacacatgcatacacaaaagatgttagcatttgcagtctgattcccaaatggcccattgcttgtgtggagagatgaagtaggatttgaaggtttttcagccttttgacagctacatatggagtcactgtaatttccttttttttctctcttctgaaaagtaggtttcggaggagggcactgccctcctggaagagatgcattagatcggtaggcacagaatacctttacatgagaccatttagagaatgattaggggccaaaggtaaggggtggactgttaagccaacagggactcagagaaagcaagggtcagggtgaccagaaatagagaaaaaaaagcctcacagaggaagaggacctggacctgagccacagaggatgggtagaacttagaaggagggaatgagcccagtctgaatgatatgtctacaaagtatacaatatgcaatgatgattaactgaaaaattgggctggccatttgtgagatccatgaataaaagtagatcagaaagtcagtgtgagttttaaatatatatattttattataaaacgttaatcacataatatgtgaaatcactattgataaccttttctattggtcctagtgttttgctatttaagataatactgcatcaaatattcttagtgtagccatccatttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaagaaaaaaaaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaaaagtcgctctcctttttttttcaaaaagatgtttttccagtgttcttgaagtcatgaaaaaatgaacttttatatttttgttaggagtacaaattaaaacagttctttgtgaggtgaatttggctctatctcatcaaagttataaataagcaaatcctttcgctaaatagttcctcttggaatatatccttcagaggtacttaactaatgctctaatatttgtatacactgatgtgcattgcagtatttttgtaataatgaaatattgggaacaacctaaatgttcagagactggttatagtacataacattatagaatgtgttatgaatattaaaaagaagaggtaggtatgtactgacatggaaagatgcctatgagaagtgagcaaagcaaggtgcagagcagtatggatctcacctttgtcaaaacaaattaaataaatgcatgctatatattcacatacctatgtgtataatatacacattgagtctttaaagttacattttatgtgaatgtacatgaaaagatttgaaggcatacatgctcactcaggatactcctaggattggggtgggagagggggaggtgataagggaagaatgttcacatctttatataatttgttatctatagttataaaaaggaaatataaatggtaccacaagatctaattacttgaggtgaacgaagattgtcagttcatgacttgcaaactactagatggattaaggagttataaaagaaatctatcaaagtatttgttcttaatttttaaacttaaaaatgaaaggaaaaaaaattttttaaatgatccccagtactggtcagagcatgaggcatagtaaatatttttacacactgcttgtgggattagaaattggcacaacttgtgcagagggagtaatttggcagtgtattgagagtgttctatctcttgactcactaagcccgcttctgagagtcttaaaggaacaaaaggaagcgagagcaaaaaaatgtttacacaaaatgttttcattgattattaaagaatatattggtgggaggtgtgcactggatatttccagggaaggagtggctaagtaaattaaggtatgctcatttgacagaatatctattatatgactcaaaatggatgcatataataaccttaacatgggaagattattggttatcatagtaaattttttaaaaggaaaaatctaagatttgatagcccttatgagctcacctctgtttaaatgtattatttatacagagattaaactggtgtaaaattaaagatagaaaactaagacaaacataagtacaaatgtgttttctgaatttctggcttaccctagagctgacctgtagggaacaggtggcaaaatagttggtgactgttgtccctaatttgtgccctcattttctccatgtgttgagtcacagccccctccaccccaattcacaattatatacccaccagggaccaatgtgacttccagaatggtttttgtccagcttggctctacttaatgtgttttacacagtctggttggcactaggtcatgttgctttctttaggtggtattttcactatcatccctttgttttatggaacctctgcactatgagccccaagatgggctttctggatttactcatgcaggttcagtaaccctaatctgaaatgctccaaaatctgaaactttctgagtgccaacatgccactagtagatgattccacatctgacctcatgtgacaggtgcaaagaaatgtttaaaatactgtataaaattaccttcaagaccatgtgtataaggtgtatatgaaacataaatgaatttcctgtttagactggggtcccatccccaagatattctcacacatatgcaaatattccaatatctgaaacacttctcatcccaagcattttggataaggaatactcaacctgtattaacaattctctgaagtcttcagatactgtatctggtctgtcctggtcacaaagcaattcttttagaaacattattctggaagcatgatagcttacaatttaatgccatgatacagtggccactatcaccactgtctgatccttcacaggatgtgtctccgtgtccctctcagccagaaggtttctgattcccacagggatcagtctccatatttacaaattttgatgctttctgaagactgactttacccttgaatttctgctcaaagctttgtgctttttcagttagaggatattgtttgcttagtgaaagtactagcatccaggcctttcttcccaataactggctttcctggttcagggatctagtcttcaagcatgcatgcatgcatatttatttatttgtttgtttgtttgacagagtctcactgtcacccaggctggagtgcagtggcacgatctcctggctcactgcaacctccatctcccaggttcaagtgattctcctgcctcagcctcccaagtagctgggattataggtgtgcaccactaagcctggctaatttttgtgtttttagtagggacagggtttcaccatgttggccaggctggtcttgaactcctgacctcaagagatttggccacctcggccacccaaaatgctgggattacaggcgtgagccaccgtgcccggccttgttttcttttcttttctttttttttttttttttttttttttgcccacaggtgctactaacaaacatttcttatctctgattttcttctcagagcctccctgacacctgcctacagtgttaatggctacagaatggctgctgggctttttctgtgggtgaaagttgtagttactagagaaacctggtttaaggctagtctacaatcatccctttctcagaggttaccctgattttaacaggctgatatttatctgtctagatatttccatgcatatttatagacatctgtttaaaacacacacacaaatgacagcacactcttcctaaaaactatttcacactaatgcttatttctctacctgtactatctttttttttttggagatggagtctctgtcgcccaggctagagtgcagtggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaata

SEQ ID NO: 5781 - DNA, 11428 bp, human
tttgctgggatttggcggcatctagtggcagactcgagaggtataaaccttactcacagaactttctggaaaattaacagtgcgtatttgcctgaagaaggtcagtgtgcttgcttggagatcaggacgcaaaggtaagagcgcctcagtcgccacagaaatccggagtccctaacggaggggaaggctgtcgtagatagatattctcacaggaaaattgtatttgtgccaagagaactgcacgcaaccttgaagggagggggtaggtgtggaggaggggagggaggacgatactagagaacttgaaagaagcctccctttggagttgctaatgcggcgatggaagggtttggctctgaatcattggagggctgtggtttacgataggattttggcacggaggaaaacgtaggaagtgtatttttaaagtaattaaatcagtacggaaagccaaaatatttctgacagtgcccctttatctgttattgtcgcctttccttaattatttattttccttttcattagaacattttcaaatataacacagaaatagataacaacctgcgcgcagtagcaaacccctccctgcaccgcccccaccatcacgcacgcgcgcgcgcccgccgtggctctcaccagtcccgacgccaggggcgcacgcctgcgcaaacacagcacctcccgagccacgagggccgctcacacagcaaccccagcaccacgcgagcctgcccgcgcactaacacactggccttaatgccttgcgcccgttgcactcacgaccctcacttgcaaacacagcagaacccccactgcgccttttttttccgtgttcggggagttgcgccacaggactgggggcgtggccccagatttgacctcgcgcttccccactcgcgggaaccttagctcatttccgcctatcctatttccgcaggccacgtagacacttcctctcccagtggggggggaaaaaaaccacaaacccataatgcctccctgcaggaaaaaaaaaaaaaaggaaaaggaaaaaaaaaaaccctctggtcagaggaactctgggtcgtgaaataggccacgtgaacattctgccctgtagacttatgacccaacggctgtcacgcttttggagggcgggctaaaaaaaaaaacctaagagggcgaacgtcattggccggaactcgtactaacggaggaagaggattggtttgctgtagaccttaacagtgaagaagcaggttgctagcacccgcctttactgcggcgaagtgtcattgctgacgtgggggtggttgtccaatcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaaaaaaaaatctattacatgtaatggaaatgtttcaagatccagaagagaaaattgatatgaatgtaactgatatggtatatgtgcatttaaaggtttattccaacaaaatgttactcacactcttttctgacacatgcatacacaaaagatgttagcatttgcagtctgattcccaaatggcccattgcttgtgtggagagatgaagtaggatttgaaggtttttcagccttttgacagctacatatggagtcactgtaatttccttttttttctctcttctgaaaagtaggtttcggaggagggcactgccctcctggaagagatgcattagatcggtaggcacagaatacctttacatgagaccatttagagaatgattaggggccaaaggtaaggggtggactgttaagccaacagggactcagagaaagcaagggtcagggtgaccagaaatagagaaaaaaaagcctcacagaggaagaggacctggacctgagccacagaggatgggtagaacttagaaggagggaatgagcccagtctgaatgatatgtctacaaagtatacaatatgcaatgatgattaactgaaaaattgggctggccatttgtgagatccatgaataaaagtagatcagaaagtcagtgtgagttttaaatatatatattttattataaaacgttaatcacataatatgtgaaatcactattgataaccttttctattggtcctagtgttttgctatttaagataatactgcatcaaatattcttagtgtagccatccatttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctcaaaaaaagaaaaaaaaaaaaagttaaataatcaaaaatcattcagaagagagtaccttaaaagacccatatacctctgagaatttagaatgttacaaaaccgtatttcataccaatggggaaaggataaactcttcagtgacgaatattagaaaaagttagttatacatttgaggaaaactataaaagtaccaataatgagtaggaaatcacttctgcagtatttttggagcattttccttaagcatgacataaaagccaaaggtcacaagggaaaaaactgatagatttgtctgtgatattgagagatgtatgcacatatacatacaacagtcatagtaagacaccgttagacaaaagaaagtgatggtttggaaaaaaatttccaacataaaataaaactaatatttaattattagaaaataatagcaaacaacctggtagaagagagaacaaaaatattcatatacgataacgtgaccattgaatgtgtgaaggatgatatcacacaaattcaaatgaaattatcttactacatgttagattggcccaagaaaagtcgctctcctttttttttcaaaaagatgtttttccagtgttcttgaagtcatgaaaaaatgaacttttatatttttgttaggagtacaaattaaaacagttctttgtgaggtgaatttggctctatctcatcaaagttataaataagcaaatcctttcgctaaatagttcctcttggaatatatccttcagaggtacttaactaatgctctaatatttgtatacactgatgtgcattgcagtatttttgtaataatgaaatattgggaacaacctaaatgttcagagactggttatagtacataacattatagaatgtgttatgaatattaaaaagaagaggtaggtatgtactgacatggaaagatgcctatgagaagtgagcaaagcaaggtgcagagcagtatggatctcacctttgtcaaaacaaattaaataaatgcatgctatatattcacatacctatgtgtataatatacacattgagtctttaaagttacattttatgtgaatgtacatgaaaagatttgaaggcatacatgctcactcaggatactcctaggattggggtgggagagggggaggtgataagggaagaatgttcacatctttatataatttgttatctatagttataaaaaggaaatataaatggtaccacaagatctaattacttgaggtgaacgaagattgtcagttcatgacttgcaaactactagatggattaaggagttataaaagaaatctatcaaagtatttgttcttaatttttaaacttaaaaatgaaaggaaaaaaaattttttaaatgatccccagtactggtcagagcatgaggcatagtaaatatttttacacactgcttgtgggattagaaattggcacaacttgtgcagagggagtaatttggcagtgtattgagagtgttctatctcttgactcactaagcccgcttctgagagtcttaaaggaacaaaaggaagcgagagcaaaaaaatgtttacacaaaatgttttcattgattattaaagaatatattggtgggaggtgtgcactggatatttccagggaaggagtggctaagtaaattaaggtatgctcatttgacagaatatctattatatgactcaaaatggatgcatataataaccttaacatgggaagattattggttatcatagtaaattttttaaaaggaaaaatctaagatttgatagcccttatgagctcacctctgtttaaatgtattatttatacagagattaaactggtgtaaaattaaagatagaaaactaagacaaacataagtacaaatgtgttttctgaatttctggcttaccctagagctgacctgtagggaacaggtggcaaaatagttggtgactgttgtccctaatttgtgccctcattttctccatgtgttgagtcacagccccctccaccccaattcacaattatatacccaccagggaccaatgtgacttccagaatggtttttgtccagcttggctctacttaatgtgttttacacagtctggttggcactaggtcatgttgctttctttaggtggtattttcactatcatccctttgttttatggaacctctgcactatgagccccaagatgggctttctggatttactcatgcaggttcagtaaccctaatctgaaatgctccaaaatctgaaactttctgagtgccaacatgccactagtagatgattccacatctgacctcatgtgacaggtgcaaagaaatgtttaaaatactgtataaaattaccttcaagaccatgtgtataaggtgtatatgaaacataaatgaatttcctgtttagactggggtcccatccccaagatattctcacacatatgcaaatattccaatatctgaaacacttctcatcccaagcattttggataaggaatactcaacctgtattaacaattctctgaagtcttcagatactgtatctggtctgtcctggtcacaaagcaattcttttagaaacattattctggaagcatgatagcttacaatttaatgccatgatacagtggccactatcaccactgtctgatccttcacaggatgtgtctccgtgtccctctcagccagaaggtttctgattcccacagggatcagtctccatatttacaaattttgatgctttctgaagactgactttacccttgaatttctgctcaaagctttgtgctttttcagttagaggatattgtttgcttagtgaaagtactagcatccaggcctttcttcccaataactggctttcctggttcagggatctagtcttcaagcatgcatgcatgcatatttatttatttgtttgtttgtttgacagagtctcactgtcacccaggctggagtgcagtggcacgatctcctggctcactgcaacctccatctcccaggttcaagtgattctcctgcctcagcctcccaagtagctgggattataggtgtgcaccactaagcctggctaatttttgtgtttttagtagggacagggtttcaccatgttggccaggctggtcttgaactcctgacctcaagagatttggccacctcggccacccaaaatgctgggattacaggcgtgagccaccgtgcccggccttgttttcttttcttttctttttttttttttttttttttttttgcccacaggtgctactaacaaacatttcttatctctgattttcttctcagagcctccctgacacctgcctacagtgttaatggctacagaatggctgctgggctttttctgtgggtgaaagttgtagttactagagaaacctggtttaaggctagtctacaatcatccctttctcagaggttaccctgattttaacaggctgatatttatctgtctagatatttccatgcatatttatagacatctgtttaaaacacacacacaaatgacagcacactcttcctaaaaactatttcacactaatgcttatttctctacctgtactatctttttttttttggagatggagtctctgtcgcccaggctagagtgcagtggtacgatctcaatctcagctcactgcaacctctgcctctcgggttcaagcgattctcctgcctcagtctcctgagtagctgagactacaggcgtgcaccaccatgccctgctacttttttttttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagt

SEQ ID NO: 5782 - DNA, 3053 bp, human
agaaggtcagtgtgcttgcttggagatcaggacgcaaaggtaagagcgcctcagtcgccacagaaatccggagtccctaacggaggggaaggctgtcgtagatagatattctcacaggaaaattgtatttgtgccaagagaactgcacgcaaccttgaagggagggggtaggtgtggaggaggggagggaggacgatactagagaacttgaaagaagcctccctttggagttgctaatgcggcgatggaagggtttggctctgaatcattggagggctgtggtttacgataggattttggcacggaggaaaacgtaggaagtgtatttttaaagtaattaaatcagtacggaaagccaaaatatttctgacagtgcccctttatctgttattgtcgcctttccttaattatttattttccttttcattagaacattttcaaatataacacagaaatagataacaacctgcgcgcagtagcaaacccctccctgcaccgcccccaccatcacgcacgcgcgcgcgcccgccgtggctctcaccagtcccgacgccaggggcgcacgcctgcgcaaacacagcacctcccgagccacgagggccgctcacacagcaaccccagcaccacgcgagcctgcccgcgcactaacacactggccttaatgccttgcgcccgttgcactcacgaccctcacttgcaaacacagcagaacccccactgcgccttttttttccgtgttcggggagttgcgccacaggactgggggcgtggccccagatttgacctcgcgcttccccactcgcgggaaccttagctcatttccgcctatcctatttccgcaggccacgtagacacttcctctcccagtggggggggaaaaaaaccacaaacccataatgcctccctgcaggaaaaaaaaaaaaaaggaaaaggaaaaaaaaaaaccctctggtcagaggaactctgggtcgtgaaataggccacgtgaacattctgccctgtagacttatgacccaacggctgtcacgcttttggagggcgggctaaaaaaaaaaacctaagagggcgaacgtcattggccggaactcgtactaacggaggaagaggattggtttgctgtagaccttaacagtgaagaagcaggttgctagcacccgcctttactgcggcgaagtgtcattgctgacgtgggggtggttgtccaatcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtttcggggtgggggtggggagaaagggtcgatgatttccttttttcgtcgggtatagacgggattacctagtgccttcacaatcggtcagagctggattcagattcctgctcgccaacgcccagcttgggcaaggctcctgttctttctgtgtctcggtttccatgtttgtaaaatggtgataataatagtatctacctcagagacgtgtactgtataatagtgcgtataaggcacgtaatgtgaagcctggcccctgaagatattagctattgttatggagataaataatacgcgtaatagaatgagaaaaattataaattatataaattcgctaattgtagtgccctttctgccatcaacttctttcctagaataaattaaagataaaatagatataccaatttttaccaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatc

SEQ ID NO: 5783 - DNA, 4488 bp, human
cccgaacacggaaaaaaaaggcgcagtgggggttctgctgtgtttgcaagtgagggtcgtgagtgcaacgggcgcaaggcattaaggccagtgtgttagtgcgcgggcaggctcgcgtggtgctggggttgctgtgtgagcggccctcgtggctcgggaggtgctgtgtttgcgcaggcgtgcgcccctggcgtcgggactggtgagagccacggcgggcgcgcgcgcgtgcgtgatggtgggggcggtgcagggaggggtttgctactgcgcgcaggttgttatctatttctgtgttatatttgaaaatgttctaatgaaaaggaaaataaataattaaggaaaggcgacaataacagataaaggggcactgtcagaaatattttggctttccgtactgatttaattactttaaaaatacacttcctacgttttcctccgtgccaaaatcctatcgtaaaccacagccctccaatgattcagagccaaacccttccatcgccgcattagcaactccaaagggaggcttctttcaagttctctagtatcgtcctccctcccctcctccacacctaccccctcccttcaaggttgcgtgcagttctcttggcacaaatacaattttcctgtgagaatatctatctacgacagccttcccctccgttagggactccggatttctgtggcgactgaggcgctcttacctttgcgtcctgatctccaagcaagcacactgaccttcttcaggcaaatacgcactgttaattttccagaaagttctgtgagtaaggtttatacctctcgagtctgccactagatgccgccaaatcccagcaaaggattggctgtttggtccctgggattctgggattttgtttccctcccccctcccctttctgatttgctgaacggtaatatctataggcatcatggatatcgttcattcctaggaaaaaataaaatcaacttctgtaaatagcactagtaggcaggggactgtgacccaagatccaaataattttgctcatttctttccttttctccttgggttaaaaaaaaaaaaaggcccctctccatccctcttttcttttgtccttgccttgtttaatcaaagagttaatgaatgacgcaagcactgatgctgaagatcctaaccctttttcctcaccttttcaaatgctcgcaactcacccaaactgaaaatacagatagctgttccgtcagtaaagatagataagaactcatcagtaaaacctggaccctggtattgaaaactgattttccttttctcttgaaatttgtatcagatatgtgtttttgcaccctattttctgtagtggtattggtaaactttattgtgtctttggagtaagagaaagagacctaattgtaaacctcattccaccacttactagtctcagtaccctgggcaaatgatttatgttttgtgatcctcagtttttttgtatgctttctatattttagatgctgtgttatatcgttcacgttgatttttttattcatcaccaagtccttattagatgagcactactggatcaaagtcaaacaacaaaaatcatacccctttcaattatctatcttatatacttgtacaccacacaggagggatttttttagagcagtggttcccaaggtgtgtttcctggatgtaccagaaacatcagcgtcacctgaaaagttgtcagaaattcggattctcaggtcccacctcaaacttaatgaatcagaagttcgcagggtggggtttagtaatctgtgttattacaaactatcccagtgattccagcacacactgaagtttgagagccactgctttggagagtagaaatgcaatgcatatttttgtacacaccactagagggtgctacagaatgtaaagcaaaataataaatgatgcacagtatatgttttcagacaccctctatattatcagtcctattttacagattaaaaactaatgtgtagatatgtcaaattattttcttagtgtacgcaacaagtatgggaaccaggatttgaacttcacctgcctctagcccaagcccctaatagtactctgttgtttaaccatgatgacttgtctttccaagcctcaaaatacattagaaatatcttgttccctgctttggctaatgttgactggagtgtcaagaagagtgcaggaaagcaaaccaagtaagtggaaatatttcgatgtttcattctcatacccttcctcatctccattctataatagcatatcacatcaaggcttctaaatgttttctttcttgttttttaattccccaaataatgttctctttactctgcagttgccttttttatttatgtctaaatctctttttttttttaacggaatttctctctgtcgcccaggctggagtgaagtggcgcgatctcagctcactgcaatctcagctcactgcaatctccgccctcccctccacccaaccccaaccctggttcaagcaattctcccgcctcagcctcccgagtagctgggattacaggcatgtgccaccacgcccggctaatttttctatttttagtagagatggggtttcaccatgttggccaggctggtctcaaactcctgacctcaggtgatccacccgcctcgcctcccaaagtgctgggattacaggtgtgagccactgcacccagccatatgtctaaatctcttctatgtgtgttgaagttatcagggtggtgaggaaacagttattgaaaacctgttatgggccacacactctatacacccattaatctcaacaataggcctgcaaattgggtgatatcatcattattttatagataatgaaagtgaattctgcagtgtgtaattacttatctttggtcatataacttgtaaatagtggaacctggataattcctggcatatctgcccatattattttactaagctttctactttttggctttgaagctggtttagttatttacttgttaagtgactttaagttatttaacttttctaagcctcagtgtcacatattaaatgggaacaaatatttctatttcataatcttagagccacactatccaatactgtagccattagtcatatgtgactatttaaatttaaatgcagtaaaatttaaaaatttagatcctcagttgcactagtctcattccaggagctcgatagctacttacagttagtggctaccatattagacagtgcagatacagaacatttccaccaccacagaaagttctactggacagtgctgatttagaggatataaggtatataaaagggcctaacacggtgcatatctcatggcagatgcccgagaaaagtgatctcgtctgcttttttctttcagcatcagagctaggggtgttctcctgttttattgatggagttgggagagggaagtaacttacccaaggtagtgtgataggggatatatctggcaccgggacccacatctcctaactcttgctctaacattctgtctagtatacccatcattatgctttactctactgagtgaggtttcaaggccaagcatgtgaacagtgtgaattaactttggaatcagggtggtagcagaaaaaggcataggaactgaatgtctcctgtgtgccacatagcactgtgcccagctttttacatctggtatcttagcaaatcctcagtgaagcccagagaataaataccccaagttgctcagcaagtaaatggcagaccaagcccaggctttttcccattatgtcatgctactccctcaaatgtgaatactcccctgccacctccacttactagtgggtcctcagaaaatgggaattactcctcttttgaatgtatagctgaaccgctgtcttcacagtctgtttcaactggaatggaaaaatagcttaggtcaatgtttgtttggctccaaggccagacagagaatatttatggtcccagccttcaaaggacaggcaatgctctgagaaccctgtgttaattttcaaggccaccattagctcataccttgcttttgtgctaattagaaaagcatgtcacctggggggcagagaaattgtagagaagggcccattccagtggaacaatgagaaaaataacttttctttctgtaggctgttgcaacctcaccagaacagctgaagaatgaatttcagcctggactctaccttattagttgggcacccttggggagggtgcaacctgcccaacattttctgctggccctgtcttacctcatgactaagagagccttcctaggtctggaaggtagcagtcagtctgttctggagggtggagagagacaccagtgttttcccatggtttctgggtagtagataaaattggtctattctaaggttaatttgatattttaaaattttgattctgactagcttattggatttttttgaataatgtttgattaatgtaaaggttaaaaataaaacctaatatttcagctaagcaaa

SEQ ID NO: 5784 - DNA, 96411 bp, human; identical to SEQ ID NO: 3546

SEQ ID NO: 5785 - DNA, 96411 bp, human; identical to SEQ ID NO: 3546

SEQ ID NO: 5786 - DNA, 103155 bp, human; identical to SEQ ID NO: 3547

SEQ ID NO: 5787 - DNA, 103155 bp, human; identical to SEQ ID NO: 3547

SEQ ID NO: 5788 - DNA, 70329 bp, human; identical to SEQ ID NO: 3548

SEQ ID NO: 5789 - DNA, 73465 bp, human; identical to SEQ ID NO: 3549

SEQ ID NO: 5790 - DNA, 73465 bp, human; identical to SEQ ID NO: 3549

SEQ ID NO: 5791 - DNA, 47142 bp, human; identical to SEQ ID NO: 3552

SEQ ID NO: 5792 - DNA, 27378 bp, human; identical to SEQ ID NO: 3550

SEQ ID NO: 5793 - DNA, 71304 bp, human; identical to SEQ ID NO: 3551

SEQ ID NO: 5794 - DNA, 71304 bp, human; identical to SEQ ID NO: 3551

SEQ ID NO: 5795 - DNA, 179467 bp, human; identical to SEQ ID NO: 4853

SEQ ID NO: 5796 - DNA, 35461 bp, human
tggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggtatgacttaactatgagcccaactgtgtgtatgttccaaataaaatcacatcaaatccaattccactaatttggaagtggcgattataaggaaagagatgggggtgagatagatagagcatagtattaatgtaagtaggatggtagtgggaatacttaggagaattgatatttcattatttttctttttcacttaacaaatgtttattgaacttctgctctataaaagatactctgctaggtacttaaggctatataaagatgtatcagataagggtcctcccttaaaagtatgtagaccaggagacattaaagcatattcattaagaaacaaaaatcaagtgagaaaaactgttagagaaatataaattcctgtcatgatttataacaaggagaaactatttttcatctggaggagtcagagaaggcttcgtggaaaaggtagcatttgcaagtcttaaaaattggtgaattttggacatatggaaatggaatgaaaagaacatgccaggtgatggaatccatgtaaccgaacataggtagaggtaaacgtaaagtatgtataggaccatgtttgtttagtttggtagaaacatagggtggatgaagtgaagtagttggagaaaaaaaatcaataaggtagattgggatagagctggagtttgaattttattttataggcagtggaggaatcattggaaaaaaattatttaggagcacacaatcaattaggataggctagactgctaacacaaacacagataatagatgaaacagtataattttatttcttgaaggaataaacaaaggagattgactcttcaggtcagtaggcagctctcctccatgagattattcaggaacttagactgtagactgacagcagactgtcattttcaaaacaaaccttcccgagtacattttcatcaccattagcactcacaggaacagggaaagagcatggagaaacaactgtgaaagattttatgggctaggcttgaaaggggcaaatatcacttcatgcacattctattggatgatcttagtcacgtggatacacctattcacaaggaagtctgtggagtatagcgtggctgagcagacatgagcagctactatggaagaagaggagattggaatgtcatggataggtagcactctgtgccatacgtttatttataatgggttgaatacctgtaattgttacatgtcaatactacctatccactgtaacttgtcaatagagattttttttttttgaaaaactgtttaagtgaatggaacatctaaatggcaaggatttttagcatattttaggatctctgaaaggtacaaaagaagcataatgcttcttttctcaaagagcttatactcacagaccctgtgatattgtctataagcagtagtttagagatagcttcaaaataggcagcacttaatattgacttctaaaagatgagagcaaagttagaaacatggagggcaggaggaaagttatttggggctaaagtatgagtgataccattcaggtgagaataagcccaccttgggagataagattggctaggttcacattggaataaaaaagtaaatttgtatggcacaagatcatgaagaatctttcaagcctgggaaaagaatttaaacttaatatggtagacagattttgttggttttgatcaaaaacccacgtgagacacatggctggctagcttgctctatctatctatctatctatctatctatctatctatctatctatctatctattctgtctctctaatcttttctatcatctgtctccatctatctatctaatgttgatatataattcacttaccacaaacgtcacccctttagtggtctctcatatattcacaaagttgtgcaaaccttcaccattatctaattccagaacattttcatcaccctaaaaagaagccccatatccattagcagttactccccatttctcctactaccaacccaagcaatcactgatctactttctagctctatgaatatgcctattgtgcacattttatataaattgagtgatacaatatgtgatcttttgtgcctgccttcttttacttagcatatcattttcaaagttcatccatgttgtagcatgtatcaggacttctttcttatgatttaataatattccattatatggatatataccacattttgtttattcaatgttaatagttatttgagatgttttcttgttttggctgttgtgaataatgctgctatgaatattcatgtacaagttttttatggacattgctttattattcttgtgggtaaatatcttgaagtgaaatttctgggttatatgataactgtctgtttaacattttggcgcactgtcaaactattttccaaagagactgcaccattttatattccctccagcaatgtatgagggttctattttttctttgtctttattttattttatttttttaccaaatctccccttcattgtatgtacaaggattctaatttctgcacatccttgacaacacttcttaattgtctttctttttgattgcagccattccggtgagcgtgaagtggtgccttggcactcttgttgaaaattagttgaccataaatgttagagtttatttctggactctcaattctattccattgatttatacttctacccttataccagtgccacattgtcttgattactgcatctgtgtagtaagttttgcaatcaggaagtgtgagttctttaactttgttcttttctaagattgttttggctcttttagttccttgtatttccatacaaattttaggatcaacttgtcaatctctgcaaacaagaaaaaaaaaaggcagctgggattttgatagtcatcatattgaatctgtagatcaatttcgggagtatttcatattaacaatattaactcttccaacccataaacacaagatgtctttccttttcatttatttaatcattctttaatctgtctcatccaaagatgttttatagttttcagtgttcaaggcttgtacttcctttgttaattttatttctaagtattttaattttttgttattatagtaaattgaattgttttcttgatttcatgttttgattgtttgttgccagcatatagaaatacaactgataactgatcttgtgttctgtaagtttgctaagcttatttattagttctagtagatttttttgtggattaattaggattttctatatacaaaatcatggcatctgaatagtgttacttttacttctcttattccagtatggatgtctttttttcccttattcttgcctagttgaccaggctagaaccttcggtacaatgttgaatagaagtggtaagaatgcatgtccctgtcttgttatttatcttaaggggagtaatcagtctttcaccataaagtataatgttaactgtgggtttcttgtagatcatctttatcaggttgcggaagttctcttatattgctagtttgttgagtgtttttatcatgaaggagtattgattttgtcaaatgatttttctgtgtcaattgagatgatcatgttattttttccatatatatatatatataaacatatatatataaacatatatatatatacacacacacacatatatataaacattgatggattgttatatgttgaatcacttttgctttcccagaataaatcccacttggccttttgggatcctttttatgtgttcttaagttcagtttgctagcatgttgttgaggatttttatgcttatatttgtaagatatattgatatatagtttttttgtgatgtcttcgtctactttgggtgtctaggtttcttagaataagttggatagcgtttcctcctttcctattttttgaagagtttatgaagaattggtggtaattattctctaaatgtttggtagaatttgccagtgaagccatctgctcttagagtttgctttgtggaaagttttttcattactaagtcaatctctttatttattataggtctatttcacttttcccattttagtttcagtagtttgtggttttttttagaaactcgtccattttatctagattatctaatttgttggcatataatttttcatcataatcacttataatcttttttacttctataaggttgatagttctctatttcctggctataataatttgagtcccccttctcacactcttgctcttgcacactctcacttttgcactcttgatctctcactcgcactatctcgttcttgctctttttttttggaaaatttttttagttaggctacctaaaaatatttctatgttttttatcctttttgtcttttttaatcttttcaaagaaccaacttttgcttttgttgatttttctctatttctagtcttttttttaattatattttaagttttagggtacgtgtgcacaatgtgcaggttagttacataggtatacatgtgccatgctggtgtgctgcacccattaactcatcatttagcattaggtatatctcctaatgctatcccttccccctccccccaccccacaacagtccccagagtgtgatgttccccttcctgtgtccatgtgttctcattgttcaattcccacctatgagtgagaatatgcggtgtttggttttttgttcttgcagttagaattatttctagtctttatcactttctgctcgcacaaagctggaagattagctggagataagagcttaggtcttttctgttctttcctaagaatacatacaactgtgagtatacataaagccatatgcatgtagttggccttctgggttcccaggaatatgtcacagtttttcaaagcccccacttttcttttaacactttgttagcgtattgtttggcccaactgctatccactgccttggatagccacatgttcaacaactgcctctgattgttttcaacaaacaccacaggggaaaaggctgtttacaccagaggagctctgtgtcaagtcaaataaagacagtcttgtgagaggagtcttccagggaaccactagacaagtcaaataacaacaattatttgggaatggggctttgctggagttccaaccccaatctgttccattcagtagctactaggtactggtttccactgtaattgctagatgttggtttctttcttttttctctctctctctcttttttttttttttttttttttaatgatagagtctcactctgttgcccaggctggagtgcagtggcatgatcttggctcactgcaacctccacctcccaggttcaagcgattctcctgtctcagcctcacgagtagctgggattacaggtgtgcaccaccatgccctgctattttttctttattgtatttttagtagatactgggtttcaccatgtcggccaggctggttatgaactcctgacctcaagtgatccacccacctcggcctcccaaagtgctaggattacaggcatgagccaccgcacccggcctagatgttggtttttaaggctactgtgaaactggggaggggggtgggaatagggcaatttaaaatgccacagagcttactggttttactgagattcagccattttattaaataaatgctacctgaattgctgtaagctattggttaatttccagagttctaaagttgattccgatgacttttgtcagtgttcttgttgcttttatagaggagagcatttttagaagttcttactctgccatttttactacatcccctcctagtatggcttcttgcatgggaaaatgattcagtaaaaactaagcttgacatcaaacagtgtactagattaggcaagaaattggcatagttaatatacaaatctatatgaaaggtatgaaagtataaaaatgagcaatggacatgaaaggattaatcacagaagagaaaatacaggttgatgttaaagtctgaaaaagaaagttcaacctcaaagaaattaaaattaaaacaatgagctaccatttttcactatcaaatcaataaagatgattatagttattacgattcacaatattggcaaagatgcagtgaaataaacatttaaacactattggtcagaaatataaattggtattttctttcaggaatttaatttggcaataatatgaagtcttttaaaaataccatgtgaccaaacaatttcatttctaggtatgtgtcctgagaaaaaagtatagttggatgaaaatttatataaaaaagataaccattgcagcattatatgtaatagtaaaaaatttgaattaacctaaatgtccaacaatagtagaatggttaaataatttatattagatccaccttagatttttttagtcattaaaaatactgttttagaagaatatttagtggcattgaatattactatatagtgctaagcaaaaaaataaagatttagtacacagtgtgatacaaattttaggagaaaaaggaagaaaaaactgcagaaaaatatatcaacttgttaacagtttatttctgggtacataggatacaagaggttttattttctcattcatacttttccattctctccaaattctatccattaaggatttattactttataataagggatgtggcaatgtatataaaagtaatgatctgacatttgtatgcaagataggtaagaagcagcagcaagttagagtggtagtgggaatgggaaggaaaaagcaaatccgaaagacgttttataagaagaaactctaggatatgaaacagatgcagcagatagagggttttcagcataatcaaaactaggataggtaagaagaatcctacttgataggggaaagaagatattcagttttggacaaaattgaggatgattcatatctgagggctatttctttataggtagttggaaatacagatgaagttcgttttctttcgttttagtatgtctttgaaaattatgtaggcttttttcagattagtgataattaaggtttttcactcttcgaaattagagaggttttgcttattatgttctgtatttattatattactgcttcacttttcttgaatgttactttataaaataactgattatcaaatgttagcctgacttcaccttgttttgccttggactggctcagagttctcatgtttccactgttattacactattattactctcagttgttcttgttgctgtcaaaaactattatgtttgaagaagtataattattacttgagcaatatttgctttttaatactgttttctatgaattttaggcaatgaatattttgacttcagtgctgcttctatatgcaaaagaggaagaagctttttggcttctggttgctgtatgtgaacgaatgttgcctgattattttaatcgtcgaattattggtaaaagaaaaaccacacacacacatatgcatacacacacagagatgtatatttcctttctaaacaatttcagtgtctcttgtctaattactaataaagtagaaggactgatggattatgttgtggtataaaatgcaagcaatatcaaaatgtcacattcactgacattctcaaaagaagagctttttgtactgaatgtatagtcagaaagattgtttaatatgttgcttttaaaaataaaatacctggtctgtttcttaacaaaaatggaagcattaagtttataaactctatgttgctaaaacaatggtgatctcaagtatccacagctactggtgaatttttgtagttttttgatgggagggagatttcaatctgcttaaaatctccatatttgtatgaattatatagatatttgcaagatttcaaagaaggatcgagttcttagtttgttaattgtataatttttattttattttattttattttattgagacggagtcttgctctgtcgcccaggctggagtgcggcctcggcttactgcaagctccacctcctgggttcacgccattctcctgcctcagcctcccgagtagctgggactacaggcacccgccaccacgcctggctaattttttttttttttgtatttttagtagagacggggtttcaccgtgttagccaggatggtctcaatctcctgacctcgtgatccacccacctcggcctcccaaagtgctgggattacaggtgtgagccaccgcgcctggccaatattttctttaatcatcaaatatttacagatctgtgaccacttaccttaaaacttatgaatggtctctttgtaccgtaataggctttcaggattgtggttaggtcatcgattttactgtctttcattataattatttgtgtattttttttttttttttttttttaggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaacatgagactatttcattaattggtatagctcttataatacctagtacaggtctctgcatataataaagactcaataaataactcttcaaatgaatttgaattgtgtttctgaagtacatgacactactagcagttagatgtataaaatacagaagaggttctgaaagagttcataatttaaggaagaagaatgagatacatcagcatgctaatagaagtggggaggtatggaaacaagtccttttgaaaaatgtttatttttaaacttcttttgatattctgtaggtgccttggtggatcaggcagtctttgaagaacttatcagggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggtattgtaagaaccataacatttaaatctggaggagatttgagagatgatgttgttcaatcccctattttacagaggaaactgagccctagaaatttcagtttgtccgagattacaaaaccacttgaatgaaagagctacacctaaagtccagtcctctatctccagaaaaaatatagcaagaataaatcactttgaagtgaaccactaaattatgtacacatttacactaatattgttgattcagtatgctaggactttcatattcccagtttgagctataaagtgtctatgtagaattagttcaagcaggaaaagcatagttgataatgttaaatatccagtggccgggaagttattctggtttctatgtggtttcaggtgggttgaactttattttcctagtagcttctgtatgaatgctattttgtattggagcacatgtgttgtatgtgtgtgtatgtgtatatgcacacatttgtatatgctaaatgaataaatttgagtgggcaactatcataatgccacatgaaatcccattatgtacagaataaaatacaaacatcttactctggcattcagaactctgtggtaagggctcagtgtacctttcttcacttatttccccctatatgcttctacataccctatattccactcttactgagctgtgtggtatttgccaagtactctctgagcctgtttgcttccttcaaaaccccaaaatgattcctacactatcccatttccctcacccatgccctcctaatgctcaaccatcttcaaactccacttcttgaccgggtgcggtggctcatgcctgtaatcccagcactttcggaggccgaggcaggtggatcacctgaggtcaggagttcaagaccagcctggccaacatggcaaaacctcgtctcgactaaaaatacaaaaattagccaggcgtggtggtgaacacctgtaatcccagctacttgggaggccgaggcagaataattgtttgaaatcaggaggcggaggttgtagtgagccaagattgtgccattgcattccagcctggatgacagatcaagactccatctcaaaaacaaaaaacaagttccacttctttttttgttattattatactttaagttttagggtacatgtgcacaacgtgcaggtttgttacatatgtatacatgtgccatgttggtgtgctgcacccattaactcatcatttaacattaggtatatctcctaatgctatccctctcccctcccccaccccacaacagtccccagtgtgtgatgttccccttcctgtgtccatgtgttctcattgctcaattcccacctatgagtgagaacatgcgatgtttcattttttgtccttgcgatattttgctgagaatgatggtttccagtttcatccatgtccctacaaaggacatgaactcatcattttttatggctgcatagtattccatggtgtacatgtgccacattttcttaatccagtctatcgttgttggacatttggggtggttccaactctttgctattgtgaatagtgccgctataaacatatgtgtgcatgtgtctttatagcagcatgatttataatcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagtacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcacatgcctatgtcctgaatggtattgcctaggttttcttctagggtttttatggttttaggtctaacatgtaagtctgtaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgtttttgttactgtagccctgtagcctggtagtatagtttgaagtcaggtagcatgatgcctccagctttgttcttttgccttaggattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacctatgagcatggaatgttcttctatttgtttgtatcctcttttatttccttgagcagtggtttgtagttctccttgaagaggtccttcacatcccttgtaagttggattcctaggtattttattctctttgaagcaattgtaaatgggagttcactcatgatttggctctctgtttgtctgttattggtgtataagaatgcttgtgatttttgtacattgattttgtatcctgagactttgctgaagttgcttatcagcttgaggagattttgggctgagacgatggggttttctagatatacaatcatgtcatctgcaaacagcaacaaagttccacttcttcataagaccttcccttgtcctctcagttgaaagtaacctctaactaactagggagaaattatgtgtcatttctctgctttaataatggtagttccactaattcttgtattactatcacttttcaataggttctttgacaatgtcactaataaggatagtccattgccttcaaatgttcagcaaggttcaaatgtgagtgatgaaaaaaccagtcatactagagtggatattacagatttgattagagaatcaaatgaggtaagttttttcatgccataaatatattagctagcatatttaaaatgattgaactatggtctatctctaatggtatattaagtgtaagataataatgcaagtagacatacaacttaaaatccaacttaacttttaaaatgagttctgtgaactgttctaggttgtgtaacctcctctgcctcaatttgtttttcattaaatgaaattaaattcacttgctttcacaaataatgaccactttaaacatctatcactggattaaaaggtgaattattctcattattattattcacttcttagagattaagaattttacctatatttttgtacttagtctattcacatagtagatggaattctctccagtgaatatatttaaaaactgaaacgtgggaggtaaaaatttgcaaaatcattgaacaagtcaggaaattccctagaaatagaatcaaggcctccaagaattcagtctgataaaactgaattgtaaaagaaaaagtggatgtttattatgagtgagtagccactgaaatcatatctcttgcagaaatatggtaatattcgctatgaagatatacatagtatgcgctgtcgaaataggttgtatgtgatacagaccctagaggaaacaacaaaacagaatgtggtaagtatgcaaccaatgaggaaaaaccagttggagtaattttttttttctataactttctttagaaattatcttctgggcgaataaaatgaaaaggactaaacttttgagctagatccttgccaaggtttaccctatggtaaattcttttttagagaaaatacattattttcttctggttgaattatgttgctttctccaacatgttttgtactatttgaccttcaagaccactgagacagggtctcgttctgttgcccaggctggagtgcagtggcatgatcgcagctcactgtagcctctacctcatgggctcaagagatccttcttcctcagcctaccgaggagctgggactacatgcacacaccaccatgcctggctaatttttaaattttttttttagagatagggtctcagtatgtttcccaggctgtctcaaacccatgggctcaagagatcctccttgcctaggcctcccaaagggttaggattacaggcgtgagctaccacacctagcctgcagctcagtgttgaatgctatcatgttggcatttaagcataacatatttgtgatgtgctgcatcagtaagaacagccgatctacatagtagtcagtgctccaatgaatattattatccttggatacctaaagtaaatactatgttttaaatacttgtctttttaatatttggatggctccataagcaactgttaatattggttgcctttggtgaatcggattaatagattgctggtcagaaggaggagagttttactttgctgtttatattcttctgtactgtttgagcttttatcatgaccatgtgttgtttttgtaaacctacttgcttaaaggccaaggtcctcagagatacaaatctgggaagattaatgtttctgaagattccaggtttagatttcaattgaataattcagtgaggttactgtgacatagttagcatagggccccttgttttagtttttatatgttagcatttttaaaaatttactgaagtaatacatgctcactgtaaataatttaagcattacataaatgtaaaaagtagattccccaccccagaagtaaccatcttaaaataatttggcatatatcctttcagatcttttatctaggtgtctgcacacatgcatgtgtattggaaggatatagtttttgaaatgagatcataccagtcactttgctctgcaacttttttcattcagaaatagatcatggttattgaatatcagtaaatatagatctacctcactcttcctaatgcattgaatagtatgccataatatggatatgctataatttattcactgctgatgtacatttaatatgtctcccttttttgctcttacaaataatactttatgtaaacattcttgtatatctattctttgcaagatagatatctggaagtggaagctgggtaaaagggtatgcccatttaaaatttgacaggtccctgccaaattatgcttcaaaagattttgccaaattgtaatcccaccagcagcctgtaagaatgcccctttccccacattctcactaacaccagatatttaaaatcttgaatttgttggccaggcatggtggcacacactcgtagtcccagctactcaggaagctgcgacgggaggatcaccttgagcctgggagttccaggctacagtaagctataatcatgccactgcactccagcctgggcaacagagctagaccttgtctctaaaacaaacaaaacaaaacaaaatcttcaatttgtgccaatgtgatagatcaaatacttttaaggtttcaattcactgatcacatatgtttattagcctttttaatttcttctcttaattgcctattcatagcctttgcttatttttctatgagattgtcttaagtattgatttgtagaagctcttttgactattagtagtaccagttctttgtcagctatatttgtggcctaatattttcccctagtcttattatttctttcattatctttataatgtctttcagattatacaagttacaaattttcttgaagtctttctcttttttattacatgatatctgggtttcatatcaaacttagcaggctttccctatttaaaattatataaattataaaaatattttttcatattggcctatagtactggtattgcttttttaacatttagaactttaatatacctagagtatatttttttattatgtaatattatgtttttccaaccaaaatcactcattttctaaaaaccaattattaaatagtttatcctcacagtactctactttcttcatatgctaaattcttatatacatacatgggctttatttttggactctctttttttgttactacaacagtaccacactctttcaattaccatagtttgtctactttgaaatctggtaaggcttttattcattttaacagtctgtctttttaaatgttctttagtaagcattttaattttcatcatctaggtcttacacatttcttattgggtttattctacccctatatattttatggttttgctgctaatatgaatgagatcatttttcctttacattgcctaattctttattggctgtgtgtgtaaaagttattgatttgggtatgttgcttttctaagtggtcgcattattgactctcattaattgtactattttttttagttgacctcgaattttctgaatagacaagcatgtcatttccagtcttagaattttgacccttcctaacatttatacctcttttcttttttctgtgttattgcattaagtaggatcttcagagaattattgaataatagcagtagaagcaggcttctttgtcttattctttttgttttttttgagactgagtctcactgtcgcccaggctggagtgcagtggcacaatctctgctcactgtaacctccacctcctgggttcaagcaattctcctgcctcagcctcccgagtagctgggattacaggtgcctgtcaccatgcccagctaatttttgtatttttagtagagatgggatttcaccatgttgactaggctggtctcaaactcctgacctcaggtgatccacccgcctcagcctcccgaagtgctgggtttgcaggcatggccaccacacccagccgcaggtttgttatataggtaaattatgtgtcacagggtttcgtgtacagattatctcatcacacaggtaataatggtactcaataggtagttttttgatcttcaccctcctcccaccctccatactcatgtaggcccctgtttctattgtttccctctttgtgtccatgtgtactcaatgtttagctcccacttataagtgagaacatgcagtatttggttttcttttcctctgttagttcacttaggataacggtctccagctccatccatgttgctccaaagaacataatattattcttttttatggctgcataatattccatggtgtatattgaccacattttctttatccagtctactgttgatgggcatctaagttgattccatgtctttgctattgcaaataatgctgtgacatacatacacatacatgtgtctttatggtagaataatttatattcctttaggtatatgcccagtaatgggatttctgagttgaatggtagttctctgttaagttctttgtgatatcttcaaactgctttccacagtggctgacttaatttacatttccaccagcagtgtattagcattccctttactccacaacctcaccagcatcttgttattttttgactttttaataatcatcattctgattgtgtgagacggtatctcattgtgattttgatttgcatttctctaatatttagtgatgttgatcatgtgcttgttggctgcatgtaggtcttcttttgaaaagtgtctgtccatgtcctttgcccacttttttatggagttgtttgatttttgggttttgttttttgtttttgttttgagacagagtcttgctgtgtcacccaggctggagtgcagtggtgcgatcttggctcactgcaagctccgcctcccaggttcacgccattctcctgcctcagcctcctgaatagctggaactacaggcatccgccaccatgcccagctaattttttgtatttttagtagagacggggtttcaccacattagccaggatggtctcaatctcctgaccttgtgatccacccgcctcagcctcccaaagtgctgggattataggcatgagccaccacacctggcctggtttttaattttttaacttcctatggattctggatattagacctttgtcagatgcatagtttgcaaatattttttcccactctgtaggttgtctgtttactctgttgatagttttactgtgcaaatgctccttagtttaattagtcccatttgtcaaattttatttttgttgcaattgcttttggcatttttgttgtgaaatctttgccaccgcctatatctagaatggtactccctaggttttcttcaaggctttttatagttgtaggttttacatttaagtctttaatccatcttgagttgatttttgtatatggtggaaggtagggatctagtttcaatcttctacctgtggttagccagttatcccagcaccatttattgaataggttgtcctttccccattgcttgttattgttgactttgttaaagatcagatggttataggtgtgcagctttatttctgggcactccattctgttccgttagactatgtgtgtttttgtacctgtaccatgctgttttggttactgtagccttgtagtatagtttgaaggtgaataacgtgatacctctagctttgttcattttgcttagtattgctttggctatttgggctcctttctggttccatatgaattttctagaatagttttttctaattctgtgaagaatgtcattggtagtttgataggaatagcactgaatctttaaattgctttggttggtatggcctttttaacaatattgattcttcctatccatgagaatggaatgtttttcatttgcttgtgtcacctctgatttctttgagaaatgttttgtaatccccattgtagagacctttcacctccatagttagctgtattcctaggtattttactctttttttggctattgtgagtaggattgagttcttgatttggctctcagcttggactttgttggtacatagaaatgctactgatttttgtattctgaaactttgccaaagttgtttactaaatctaggagcttttgggctgagactttggggttttctacatatagaatcatatcatctgcaaatagaaatagtttgacttcctctcttcctatttggatgccttttatttctttctcttgcctgattgttcgggctaggactgtctgtactatgttgaaccagagtggtgagagtgggcatccttgtcttctggttctcaaggggaatgcttccagcttttacccattcagtatgattttggttgtggatttgtcataaatggctcttattattttgagatacagttcttcaatgcctagtttgttgaggctttttaacacgaagtgatgttgaatcttactgaaagctttttctgcatctattgagacgatcgtgtggtttttgttttagttcgtttttgtgatgaattgcattaattgatttgtgtatgttgaaccaaccttgtatcccagggataaagcatacttgctcatggtgtgttagcattttgatgtgctgctagatttggtttgctagtagtttgttgaggatttttgcatctgttctcctcaaggatattggcctgaagttttctcttttttttgttgtgtctctgccagttattggtagcagaatgacactggcctaaaagaatgcgttaaggaggagtcatttctcctcaattttttgcaatagtttcagtaggaatggtaccagctcttctttatatgtctggtagaatttggctgtgaatccatctggtactgggctttttatgattggtgtgtgtgtgtgtgtgtgtgtgtgtgtgtgtgtgtgtgtgtgtgtttctgattcaattttagaacttgtttttggtctgttcagggtttcaatttcttcctggtccaatcttggcaagttgtgtgtttccaggaatttatcatttcttctaggttttctagtttgtgtacatagaggtgttcatagtagtctctgagggtattttttgtatttctgtggggtcagtggtaatgtctctttgtcatttctgattgtgtctatttgtatcgtctcttttttctttgttagtttagctagtggtctatcagtcttatttattcttttaaatagccaactcatggattcattgatcttttgtatgggttttcatgtcttgatttcattcagatcagctctgattttggtaatttcttgtcttctgctagctttgggattggtttgttcttgttttcctagttcctctaggtgtgatgttaggttgttaatttcagatctttctaacttttttatgtaagcatttatgctgtaaacttccttcttaacactgctttaactgtgtaccagagattctgatatgttgtatctttattctcattagttttaaatatttcttgatttattccttagtttcattgcttacccaaaagtcattcaggagcagattgtttaatttttatgtgattatatggttttgagcaatcttcttagtatttattttcatttttattatgctatggtccaaagagtatagttgttatgattttgggttttttgaatttgctgaggattgttttatgtctgattgtgtggttaattttagagtatgtgccatgtgcagacgagaagaatatgttctgttgttttggggggaaaagttctgtagatatctgttaggtccgtttggtcaagtgttgagttcaggtcccgaatatctttgttagttttctgccttgatgatatgactaatactgtcagtggggtgttgaagtcccccactattattgtgtagttatctaagtctctttataggcctctaagaacctgtttcatgaatctgagtgctcctgtgttgactgcatatatatttaagatagatgtcttcttgttgacttgaatcctttaccattatataattccttttttgttttgttttgttgttgttgttggcctaaagtctgttttgtctgaaatcagaatagcaagccctgcttttttctgttttccatttgcttggtagattcttcctcaaccttttactttgagcctttggatgtcattgcatgtgagataggtctcttgaagacatcattcagttgcatctcactatcttatccaacttgccactctgtgccttttaattagggcagtctagttacattctggttagcctgtttacattcaaggttaatattaatatgtgtagatttgatcctgatatcatgttgttagctgattattatgcaaaactgattgtgtagttgctttattgtgtcaatagtctatgtacttaagtgtgtttttgtagtggctgataatcgtctttcctttccatatttagcactcctttcaagatctcttgtaaggcagatctaatgaacatgaattcccttagcacttgcttgtctgagaaggatcttatttctcctttgcttatgaagcttagtttggctgaatacgaaattattggctggagtttcttttctttaagaatgctgaatataggccttcaatcttttttggcttgtagcatttctgctgaatagtacactgttaggctaatgggatttcctttttaggtgacctgctccttatctctagctgcctttaatattttttctttcatgttgaccttggagaatctgatgactgtgtggcttggggatggtaatcttatatagtatcttgcaggggttctctgcatttccagaatttaatgttgtcctgtctagcaaagttggggaaatgttcatttatttttgtctaagttaattcagagaaccagtcttcgagttctgagattccttcctcagcttggtctattctgttgttaatgcttgtgatagtattatgaaattcttgtagtaagtttttcagccctatcagatcagtttgattctttcttaaaatggtcattttgtctttcacctcttgtatccttttattgtattccttagattccttggattgggtttcaacattctcctgaatctcaatgatcttcatttctatgtagattctgaattatatgtctgtcatttcagccatttcagcctggctaagaaccactgctggggaactagtgcagttgtttggaggtaaggtgacactctggttttttgagttgccagagttcttgtgctggttctttctcatctgcgtgagctgatattcctttaatctctgaagttgttttcctttggatgggtttttttttgttttttttttttttttttttttttttgcttttatcttctttgatgcccttgggggtttgattgtggattcagttgactggctttgattttgaagatttcagatggccaaggctcacctgagctctcctgagatgagtgtgctacctctgcggggctggtaccagacccccagctttgttctctgggccctcggggctaggaacctgctctgccagagaggccaaggtgttcccagtccactggcctcaacactacaatggaggtgctagccaaaacacttagtcggggtggtggcggtggaatccatgcttgctcgtgcatgccagcatccgtggcagcgtggcagcatacacatgcattggctcaggctgggtgctcgtaggagcctttaccttagttttcacaggtggtgtatactggcagaatattttagtgttgtcttttgggctgcgatccagtaggtggcgcttaagagtgttagccagcagatagcttcttgctctgctgcatggctccagggtaatggtctgtgaatggggacagggagatggcccattcacctagtccacccctgggccttggaggaaccccttctgattactggcttcatgcccgcatttcttttgttgggtgctctggtccacagggctccctcaggtaggagccacagttggcaaacaggtcttatccttactgggtcggccctgtggagggaggcacacaccacccctctatcaagctgcgaacctgggtgtctcatctctcagtgatgcttgggcaccacctaagtcagaaagtcccgcccaactgggagctgcgggagtgagtagtgtcacctaatctgctgtccaagtgcatcctgagggtaccaggggttgcaactgccagcagagtttaggcagaagctggaccactggactggaagctctaacaggcattgcccacctggctaccagtggtggagcgtggtggggtcacctgccctgcctgttgggtgtttccagtgacaacaggatgttgcagccactggctaagttcaggcagaagcgggacatctgggctggaagctccagcaggtgttgctcgcctggctaccagtgacaggagcaggtggggtcgtccgccctgccgtgtaggtgtttcatgggacaacaggaggctgcagcctctggccgatttcaggcagaagcggtagtgctgggctggaagctggcaccaagccttgtctggtgaggagggtggaccaatcctactgctcccaggcaccatgactttggcctctattggggctgtggcgctggtgttggtctgttccaggatccgaggcttgtagaggtccccttggacttaagagttgcctctgcaaaccgtctgggtggctctctgcctcagtttagaggtgaggtgggaggatgagagtggcaagtagggggttagggcaggggaattctcccactcccagccttacacagatccccatggagagtgtgaattaccctctcccgtattggggagcttctcctgactccgcattgatgccagataggctgctgcccagcttccctcctctctgctctctgtgtccccttgctgctttgatggttcccagtgtggtttcttagatgattggcttttagggtcagtgttcactaaaccctttgtttcccctccataagagagcagcacccatgatctgcttctagtttgtcatattggcccctcccatgctgggcaccttttttttttttttttttttttttttgagacagtctcactctgtcgcccaggctggaatacagtggcatgatctcggctcactgcaacctctgcctcccgggttcaagtgattcttgtgcctcagtctcctgagtagctgcgattataggcatacgccaccacacctggctaatttttgtatttttagtagagacagggtttcaccaagttggccaggctggtcttgaactcctggcctcaagtgatctgcctgccttggcctcccaagtgctgggattacaggcatgagccaccattcctctgctgggcactttaaatgacttctgtatccatgcttaaattatccacttctcgatgatagtcatttgtgatttctttcatctcacttgccagaaatgtgtctatcttattgattttttcaataaaccaactcttaattttatttactgagtctaccgggtttttttaattttctgtatttcatcaattctagcttttttctttacctttgctttcaaatttcttagatatcataatgattgtatcattagtccttcttcttcatggaataggataaaagtacatattttctaagcttattacttcttggattatgttttttggcatagagagggaatgtacatctcccaatgcctttgaagtatttaatagcaacctcacatgatgactagatatgctgcttatgtggcaagagaggaatatatggaataggacttagaatactgttacttatatttatagacattaagtggctgttctttggcagtgatttctgagtatgaagagatgaatatcaaagtacatattagagtagaattgaactagtctactactactttttaaaaggaaaaatagataataactttataatataataacttataataactttttattattcatttaagaagttaaaacacaaatattttcttctagcagagagagactctaaggtaattcaaagagaatttctttactgcaatgttaaaatctgtgtactaaattgcttttaatctttttaaagttgcgtgttgtatcacaagatgtgaaattgagccttcaagaattggatgaactttatgtcatctttaaggtactgttgttcttctttaaatgaaaaataatgcttttttttagcagaattgtatcacagccattctaattatttttatctttattttagcagacatggtttttaaaatcttccaaaattactttttctaattagtaactttccttttttatttatttttaatagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattggtaagatgatttttttaagcaaaaaaaaaaggtgctcctagaaatacttagtactgcctattattgccaatttagtcagattatatcaccatgggttacagtgtgtttagctttagtaataaatggacccttttctgcatttgttgctaaatctaagtattttgatattattttccccaaccctttcagaaaagcaagctgttagatgtgagtgttttaagggttaacataaggaagataacgtcccaattttcccacactcagatgcatgggtactaccgaaggacttcccccaccccaccgacctccccgtaaaaattcaaccacatagcctagaagagtggtagataaatacccagcaaacatgttgtacctacagatagtcaagatgttgtacctgtagatattgttcatttgcttttccagataccccagcatgctttcttatcagggatcaccccttgaagaacagttctctcctgcacaggcctcattcaaaagaaaagagaaatctgagattggggggaaggagctaggaaagagaacattttacttttttgataaagagtattttgcttatacagttatacacttgaaggagagcatctgattgactaggtggttgtttaattgttagcttaagtaacaggtttctaaatcctaatttttgactaatgtctatatcttaattaatctttgttgctgaaattgattgaatgttctttagatacatgattatttacaattgaattttattgaacagacataatgtacaatggaagttttactgagaagcttaagctgctttttaagctacatattcctccaggtaagagtttaccagtctttaacgatgtacagcaggaatttattccattttagcaagtataattacagatttttttaacaactaaactaattttcaacatgatataagatcgttgcttcactgtggccctcaaattatattatgactactttttgctgatatagatacagtgatcttctatggaagagattctgtgtaacatatgggcccacaagtttccttcctgttagtagtcaatttaatgataagtagtttgtatataagaatcacatatcatttgattgttggtataatgttgaattgttgttgttgtcattagagtggaaattaactttagacaaactgccaaacctgcgaaatactacaaattattcagaaaaatgggacaaggaagcagggatattaaatattttaaaaaggaagcacaataaacgctatcatttattaagcacctgctctgtcaagacattaactttacatgcatttttaaaatttaattctcataatatccatgataggtggcattatccttccaattttgatgataaggaaactgagagctggaaagataaaaatttgccaaagatcacatcgctaataaattgcatagcaaactgaagtctgactccaaagctcacatttctttatattcttccgtactacctcaaaattaccacaccattcagtttacttgtttttcccactgacctgaagaggatgccttgccaaagcctgatccctactttgtgaaaacagtcttaggctttaaactgaaggagcattgcaaaaagtaccttttagccgagatggggtagttcacaaaaacaaacagcacctcataatttgtttaaagctacacctgggatcccttttcagcttttctcaggatagccgggaaacattctttaccacaccaacaaggtaaaggccatctttaacccttcacacactcaaatcacaaacacatcattaaaagcaaaagacaaatcacctaaaaatttaattataaaaggagtttccattgtcaaatcaggctactgttagaatgtttaatattgtcatcaactatgcttttaacagagggataaaaaaataggaaaaacattatgtacctgttaaagcacaagtaggaagtaaaccaaagcacccaactttctgttttccttattattgaggatgttttttaaatggctgaggtcacattttcagagatttctaaatgccagatttaaacaatttcaacttttaatagctcttggaaaaccattaaaaaaacaagtaggaaaaaaatagaactcaaaatgatcaactacttcttgtatttactatattttatatatattacatatattacagtataattactatatattacagtagagtagaaccacttctgtatttcttcacttacatctttcttatacagaaactctttaacacccagttcccagatatacctgacccattatgaacctcatctctgcccctggttgttaataaatgtaatttgggttatttatatgttttcagcttacactgaagtgaaatctaaggatgcttcaaaaggagatgaactttccaaggaagaattactttatttcagtcagctgcatggtaaatacctgtttaaaatgttaactgttttgatgattagccacccataaagatcttgctgacttagatatactttacccaactaaaattgggcttcattttaacttatacttcttttgtattaccacagcacttagcatggtccataaatgtttgaccggttaaccaaattgcattttggtgctttgatttgtggaatttcttgcttattggagactcaataatgtattttgtttctacttacgttgcagaaatttctaaaatgtattagaccattttcatgccttgataaaatacaatagaatctttgatgattaaaggccatagctatttttcaaacagtgaatacttattataaatcactgtaggtgtaggagacagggatgagtctgtctccaagacaaaatttaaagtgatatgagtttatttttgtgtcctttagtttattttcataaatattcaatgtcctatagagggatgaaccctgattaatgtatatttgtggttattatatgttaaagtgtttgaacattaagtttgaagggaccttacaaatcatctagtcaagtctcttccttttatagataaaggcactaaggcccagagagaagtgacttgtgcaaggtttcacagtgagttgttgccacagtcagggctttgtagcacactcttctgacgtccagtatgtgctttttttctcctgataataaaagtaatataactttatttaaagaaagtcacaaagaagaaaataccacccagaaataaatacttaatatttggtatgcttccttctaagattttttaaaatacggattttcccccaatgttctttttactgtgaaagttttggaatattttgtcttctgatgataggtcaagtcagctaaaatttgtttgcagaattgaataaaataatgtgcttatacgtctatatgaaacattattttgctttcaaagagtatttgttaaacatcttacagaatgcaattacatcttttcttatagtttccaagcctgcaaatgagaaggaagcagaatcagcaaaacacagccctgaaaaaggtactatgatctaggagttatcatttaatttatttagttatttttatgtaaataaggatagctacaaagggggaaaaggtggattccttttaaaggctattgatgtctcagaaattatagaaaatatgatagtaaatgacccatattcatttaattttattatttttaaaagatttgtttttaattacaaaagtaatagataattcttagaaaagaaattcagacagtacataagtccttttgtcttcactcaaccctacccgaaaacatttttgtctatatccttttcagatctattcctatgtatacacaatatatgcagacatctctcttttttaaaaaaatattccataagtactgttttataatttcctttttggattttgcagtatatcatggacatcttttaatgtcagtacatttgtatcttaaactctttgaatgaataagtagtgtttcaaatttttgaaaaagagctactaaagaccactttgttttgtttgttttgagatggagtcttgctctgtcgcccaggctggagtgcagtggcatgatctcagctcactgcaacctctgcctcctggattcaagccattctcctgcctcagcatcccgagtagctgggactacaggcgcccaccaccacacccggctaattttcatatttttagtagagacagggtttcaccatgttggccaggctgatctcgaactcctggcctcaggtgatctgcccacctcggcctcccaaagccctgggattacaggcgtgagccaccgtgcccagcccactttggaacaatatatgcatattaagaacataatatagaagctgttttaaacttaatagtatacatgagaatgactacataaaatttgcattattaagtcggggtgtattgttttaatctaaatatgtcctttctccctctctcgccacatattccctagttcccaactttcctaaagtaaacgttttagtctaaacagaaatgggaaaagtattctgagagccagtgggtgaaatgaaaggtaatttcagatcatttcctggattaaaaaaatgggatcttatatctcagtgaaataccttttaatcataattattatttttgaattttgggaaagtatagtgggctgttccttatgaaatggttttactccctttcttcaggcaaagggaaaattgatattcaagcatatctaagtcaatggcaagatgagcttttcaaaaaagaagaaaacattaaggatttaccaagaatgaatcaggtatagcatttttaaaaagaaaattctaagttcttgcttttttgtatggatgtgggtgtaacctctaaaatagctaacatgctattcccaaaatagttaaataatctatctattagctctctaagtttcagatgagcatggaagagtgggaagaaattttttaatgatttttttatttttaacactcaaatgtgtccagtgtttcagagaattcttctgctgtgacatgtacctatagaaaaaaagtatgtgtagtatatttccaactttattggaaatgttcatttattcagtaaacatttgtttactgtataccagataccaaacccaatgctaggtactgggaatgataaattactgagatgggtcacaccctggttcctactgatcttatatctgaacataattttaagttcatctctttcttatacactgcctaatcaaaatatgttcttctttttgtaattaaaatctggttagtacagatactgaggatcccgagaactttaccaaaatgaaaactatcaaataacttcatatttctcagtggactatatcatttgacaattgaataagtactttctaaaatgagtcagtatgacatatttattctagaattactataaatgaacagtactattgtttagggaaaaattctctcaaactgccttttttcctctactctcacaccatgacaataacaatcatcaacatagaagaaaatgtctgtggccaaatgtgtgggggttttccccccaaccaagcagcagataccagctgagtgtcctccaattaaattccaacactatctacctagaaatagtatgagatcccacaggttgagtgttcagtccccaagactgctccctcctttcccccagtaacaagtctgagcctcctgaacttctggctgaccaacttcaagttggggttcccactatcccttctttgagttcgattaatttgctacagagagacttacagaactcagagaaatagttatatttactggtttactaagaaggatattttaaagaatacaaataaacagccagaagaagagatacacagggcgaggtctggaagggtcccaagcgcaggagcttctctccacgtggagttggggtgcaccaccctcccggcatgaggatgagttcttctttaccttcctcctgtcagcctccatgcattcagctatcagaagctccctgaacccagttatcttgggtttttatggaagcttcatgatgtcagcattccttcccctaagggtatgaggtaagaccctttctagggagggttttaagaccgactatcagaaagctactctggaggatgaggcaggagaatcacttgaacctgggaggtggtggttgcagtgagccgagactgcaccattgcactccagcctgggcgagctgagatttaaccattgcactccaacctgggtgagctgagatttcaccactgcactcaagcctgggtgacaagagcgaaactctgtcaaaaagaaagaaggaaggggaggggagggggagggggaaggaaggggaaggggagggaaaggggagagaagggaagggaagaaaagactgtaacaaaggactatgggagttgtgaactaggaacccagaaaaatatttatatatatatatatatatatatatatatatatggaattcaggattaaacatcttaaacaattcttaaacaaaagcctatgattctaatgtcagtgacttttcattccatggaagcaggtcaaagtgcagcctaatttatgcataattttaactatatttctgtccagaattcttgttcaccctctgaggacagcttcaaagggactttgcctaattagaagtaccacctggccaggcgcagtggctcatgcctgtaatctgagtgctttgggaggccaaagtaggagaggagcacttgaggctaggagtttgagatcagcccaggcaacatagtaagatcctgtctctacaaaaaatgtgaaaattagccaggcatggtggcatgtgcctatagtcctagctacttgggaagctgaggtgtgaggatcacttgagcccagcagttggaagctgcagtgagctatgattgcaccatggtactcaagcctggacaacacagcaaggccttgtctaaggaaaaaaaaatagcacctaacatttaagtaatgctggcaggcaaacagtccaggaattagtctggataaaatgtactattaggcaataagtgagagcacttaaatgaaattttcttccatggttcatactcatctttttttttaagatggagtttctctcttgttgcccaggctggagtgcaatggcacgatctcggctcactgcaacctctgcctccatggttcaggcgattctcctgcctcagcctcccaagtagctgggattacaggtgcctgccaccacgcccagctaattttttgtatttttagtagaggtttcaccacgttggccaggctggtctcgaactcctgaccccagatgatccacccgcctcggcctcccaaagtgctgggattacaggcatgtgccaccgcgcctggcccatactcacctttctagaaccaatatgtattttggggttaatcaccagttcttataacttctagggtgaagcttctatggtacaaatcctatataggagactattcacttctaagttctctttatatttgctaagtctaatattcaaacgtgatattttcaacttgtgtcttctagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttcaaaaaaaaaaaaagcaaaccatacttgtccactgtcctgtgctattcctaccaaggacaatttattaatcaattgacttagaaaatagggggagaaatcattcattggagcttctttctttagaaaagactttggttataagccttttgacttttctagatgtgaaaccatgaaagggcagacctccttcagagtgactcaagaggtctccctttcttggagggagttggtacagtcagcctttgggaagaatccactgtgaacaaagcttaacacatggggcttcatcgctcatagaatatgttattttcaaagaagttcaagaattttcaagttgagcctttgaaaatcccataaattggttttagctaaacacttactagtagtgtctttaaattatttaatcaaccttgtcttttcaaggaaattaccacttaaagagatagttggtaaataaacatctatgccttttctcagaaatgatttgctgaactatgtccatattttacagcttagataatagtttatatggaaactattatacatctgctattgtgcaatgattgttaaattatactgaagtagctctagaaagacacatgtatacaaggcactattgtacacactttgctgaatattttgtcagttgtatttacaaagaaaggtactttcttaagagcatatatgttattaatatttgatatgattttaaagtcagaatagtacagattgctgagtattatactttaggctagattaattaaaattgaatactgaaagagattttttgagttgcaaaaagtttataaatgcaaagcaaaaagaaaacatttattttctgagtctgcaggagaaacaaactaaacattatagttttatagctgctatcttgttaaccaaacaggttgttcataatattaaaaatcttacgtagttgtgttaaactgaaccagttcattataccttatgcattaaattaaatatgttataaggtggctttacttgtctttataaaaataaatatatctactaaacatg

SEQ ID NO: 5797 - DNA, 21594 bp, human
tcaataggttctttgacaatgtcactaataaggatagtccattgccttcaaatgttcagcaaggttcaaatgtgagtgatgaaaaaaccagtcatactagagtggatattacagatttgattagagaatcaaatgaggtaagttttttcatgccataaatatattagctagcatatttaaaatgattgaactatggtctatctctaatggtatattaagtgtaagataataatgcaagtagacatacaacttaaaatccaacttaacttttaaaatgagttctgtgaactgttctaggttgtgtaacctcctctgcctcaatttgtttttcattaaatgaaattaaattcacttgctttcacaaataatgaccactttaaacatctatcactggattaaaaggtgaattattctcattattattattcacttcttagagattaagaattttacctatatttttgtacttagtctattcacatagtagatggaattctctccagtgaatatatttaaaaactgaaacgtgggaggtaaaaatttgcaaaatcattgaacaagtcaggaaattccctagaaatagaatcaaggcctccaagaattcagtctgataaaactgaattgtaaaagaaaaagtggatgtttattatgagtgagtagccactgaaatcatatctcttgcagaaatatggtaatattcgctatgaagatatacatagtatgcgctgtcgaaataggttgtatgtgatacagaccctagaggaaacaacaaaacagaatgtggtaagtatgcaaccaatgaggaaaaaccagttggagtaattttttttttctataactttctttagaaattatcttctgggcgaataaaatgaaaaggactaaacttttgagctagatccttgccaaggtttaccctatggtaaattcttttttagagaaaatacattattttcttctggttgaattatgttgctttctccaacatgttttgtactatttgaccttcaagaccactgagacagggtctcgttctgttgcccaggctggagtgcagtggcatgatcgcagctcactgtagcctctacctcatgggctcaagagatccttcttcctcagcctaccgaggagctgggactacatgcacacaccaccatgcctggctaatttttaaattttttttttagagatagggtctcagtatgtttcccaggctgtctcaaacccatgggctcaagagatcctccttgcctaggcctcccaaagggttaggattacaggcgtgagctaccacacctagcctgcagctcagtgttgaatgctatcatgttggcatttaagcataacatatttgtgatgtgctgcatcagtaagaacagccgatctacatagtagtcagtgctccaatgaatattattatccttggatacctaaagtaaatactatgttttaaatacttgtctttttaatatttggatggctccataagcaactgttaatattggttgcctttggtgaatcggattaatagattgctggtcagaaggaggagagttttactttgctgtttatattcttctgtactgtttgagcttttatcatgaccatgtgttgtttttgtaaacctacttgcttaaaggccaaggtcctcagagatacaaatctgggaagattaatgtttctgaagattccaggtttagatttcaattgaataattcagtgaggttactgtgacatagttagcatagggccccttgttttagtttttatatgttagcatttttaaaaatttactgaagtaatacatgctcactgtaaataatttaagcattacataaatgtaaaaagtagattccccaccccagaagtaaccatcttaaaataatttggcatatatcctttcagatcttttatctaggtgtctgcacacatgcatgtgtattggaaggatatagtttttgaaatgagatcataccagtcactttgctctgcaacttttttcattcagaaatagatcatggttattgaatatcagtaaatatagatctacctcactcttcctaatgcattgaatagtatgccataatatggatatgctataatttattcactgctgatgtacatttaatatgtctcccttttttgctcttacaaataatactttatgtaaacattcttgtatatctattctttgcaagatagatatctggaagtggaagctgggtaaaagggtatgcccatttaaaatttgacaggtccctgccaaattatgcttcaaaagattttgccaaattgtaatcccaccagcagcctgtaagaatgcccctttccccacattctcactaacaccagatatttaaaatcttgaatttgttggccaggcatggtggcacacactcgtagtcccagctactcaggaagctgcgacgggaggatcaccttgagcctgggagttccaggctacagtaagctataatcatgccactgcactccagcctgggcaacagagctagaccttgtctctaaaacaaacaaaacaaaacaaaatcttcaatttgtgccaatgtgatagatcaaatacttttaaggtttcaattcactgatcacatatgtttattagcctttttaatttcttctcttaattgcctattcatagcctttgcttatttttctatgagattgtcttaagtattgatttgtagaagctcttttgactattagtagtaccagttctttgtcagctatatttgtggcctaatattttcccctagtcttattatttctttcattatctttataatgtctttcagattatacaagttacaaattttcttgaagtctttctcttttttattacatgatatctgggtttcatatcaaacttagcaggctttccctatttaaaattatataaattataaaaatattttttcatattggcctatagtactggtattgcttttttaacatttagaactttaatatacctagagtatatttttttattatgtaatattatgtttttccaaccaaaatcactcattttctaaaaaccaattattaaatagtttatcctcacagtactctactttcttcatatgctaaattcttatatacatacatgggctttatttttggactctctttttttgttactacaacagtaccacactctttcaattaccatagtttgtctactttgaaatctggtaaggcttttattcattttaacagtctgtctttttaaatgttctttagtaagcattttaattttcatcatctaggtcttacacatttcttattgggtttattctacccctatatattttatggttttgctgctaatatgaatgagatcatttttcctttacattgcctaattctttattggctgtgtgtgtaaaagttattgatttgggtatgttgcttttctaagtggtcgcattattgactctcattaattgtactattttttttagttgacctcgaattttctgaatagacaagcatgtcatttccagtcttagaattttgacccttcctaacatttatacctcttttcttttttctgtgttattgcattaagtaggatcttcagagaattattgaataatagcagtagaagcaggcttctttgtcttattctttttgttttttttgagactgagtctcactgtcgcccaggctggagtgcagtggcacaatctctgctcactgtaacctccacctcctgggttcaagcaattctcctgcctcagcctcccgagtagctgggattacaggtgcctgtcaccatgcccagctaatttttgtatttttagtagagatgggatttcaccatgttgactaggctggtctcaaactcctgacctcaggtgatccacccgcctcagcctcccgaagtgctgggtttgcaggcatggccaccacacccagccgcaggtttgttatataggtaaattatgtgtcacagggtttcgtgtacagattatctcatcacacaggtaataatggtactcaataggtagttttttgatcttcaccctcctcccaccctccatactcatgtaggcccctgtttctattgtttccctctttgtgtccatgtgtactcaatgtttagctcccacttataagtgagaacatgcagtatttggttttcttttcctctgttagttcacttaggataacggtctccagctccatccatgttgctccaaagaacataatattattcttttttatggctgcataatattccatggtgtatattgaccacattttctttatccagtctactgttgatgggcatctaagttgattccatgtctttgctattgcaaataatgctgtgacatacatacacatacatgtgtctttatggtagaataatttatattcctttaggtatatgcccagtaatgggatttctgagttgaatggtagttctctgttaagttctttgtgatatcttcaaactgctttccacagtggctgacttaatttacatttccaccagcagtgtattagcattccctttactccacaacctcaccagcatcttgttattttttgactttttaataatcatcattctgattgtgtgagacggtatctcattgtgattttgatttgcatttctctaatatttagtgatgttgatcatgtgcttgttggctgcatgtaggtcttcttttgaaaagtgtctgtccatgtcctttgcccacttttttatggagttgtttgatttttgggttttgttttttgtttttgttttgagacagagtcttgctgtgtcacccaggctggagtgcagtggtgcgatcttggctcactgcaagctccgcctcccaggttcacgccattctcctgcctcagcctcctgaatagctggaactacaggcatccgccaccatgcccagctaattttttgtatttttagtagagacggggtttcaccacattagccaggatggtctcaatctcctgaccttgtgatccacccgcctcagcctcccaaagtgctgggattataggcatgagccaccacacctggcctggtttttaattttttaacttcctatggattctggatattagacctttgtcagatgcatagtttgcaaatattttttcccactctgtaggttgtctgtttactctgttgatagttttactgtgcaaatgctccttagtttaattagtcccatttgtcaaattttatttttgttgcaattgcttttggcatttttgttgtgaaatctttgccaccgcctatatctagaatggtactccctaggttttcttcaaggctttttatagttgtaggttttacatttaagtctttaatccatcttgagttgatttttgtatatggtggaaggtagggatctagtttcaatcttctacctgtggttagccagttatcccagcaccatttattgaataggttgtcctttccccattgcttgttattgttgactttgttaaagatcagatggttataggtgtgcagctttatttctgggcactccattctgttccgttagactatgtgtgtttttgtacctgtaccatgctgttttggttactgtagccttgtagtatagtttgaaggtgaataacgtgatacctctagctttgttcattttgcttagtattgctttggctatttgggctcctttctggttccatatgaattttctagaatagttttttctaattctgtgaagaatgtcattggtagtttgataggaatagcactgaatctttaaattgctttggttggtatggcctttttaacaatattgattcttcctatccatgagaatggaatgtttttcatttgcttgtgtcacctctgatttctttgagaaatgttttgtaatccccattgtagagacctttcacctccatagttagctgtattcctaggtattttactctttttttggctattgtgagtaggattgagttcttgatttggctctcagcttggactttgttggtacatagaaatgctactgatttttgtattctgaaactttgccaaagttgtttactaaatctaggagcttttgggctgagactttggggttttctacatatagaatcatatcatctgcaaatagaaatagtttgacttcctctcttcctatttggatgccttttatttctttctcttgcctgattgttcgggctaggactgtctgtactatgttgaaccagagtggtgagagtgggcatccttgtcttctggttctcaaggggaatgcttccagcttttacccattcagtatgattttggttgtggatttgtcataaatggctcttattattttgagatacagttcttcaatgcctagtttgttgaggctttttaacacgaagtgatgttgaatcttactgaaagctttttctgcatctattgagacgatcgtgtggtttttgttttagttcgtttttgtgatgaattgcattaattgatttgtgtatgttgaaccaaccttgtatcccagggataaagcatacttgctcatggtgtgttagcattttgatgtgctgctagatttggtttgctagtagtttgttgaggatttttgcatctgttctcctcaaggatattggcctgaagttttctcttttttttgttgtgtctctgccagttattggtagcagaatgacactggcctaaaagaatgcgttaaggaggagtcatttctcctcaattttttgcaatagtttcagtaggaatggtaccagctcttctttatatgtctggtagaatttggctgtgaatccatctggtactgggctttttatgattggtgtgtgtgtgtgtgtgtgtgtgtgtgtgtgtgtgtgtgtgtgtgtttctgattcaattttagaacttgtttttggtctgttcagggtttcaatttcttcctggtccaatcttggcaagttgtgtgtttccaggaatttatcatttcttctaggttttctagtttgtgtacatagaggtgttcatagtagtctctgagggtattttttgtatttctgtggggtcagtggtaatgtctctttgtcatttctgattgtgtctatttgtatcgtctcttttttctttgttagtttagctagtggtctatcagtcttatttattcttttaaatagccaactcatggattcattgatcttttgtatgggttttcatgtcttgatttcattcagatcagctctgattttggtaatttcttgtcttctgctagctttgggattggtttgttcttgttttcctagttcctctaggtgtgatgttaggttgttaatttcagatctttctaacttttttatgtaagcatttatgctgtaaacttccttcttaacactgctttaactgtgtaccagagattctgatatgttgtatctttattctcattagttttaaatatttcttgatttattccttagtttcattgcttacccaaaagtcattcaggagcagattgtttaatttttatgtgattatatggttttgagcaatcttcttagtatttattttcatttttattatgctatggtccaaagagtatagttgttatgattttgggttttttgaatttgctgaggattgttttatgtctgattgtgtggttaattttagagtatgtgccatgtgcagacgagaagaatatgttctgttgttttggggggaaaagttctgtagatatctgttaggtccgtttggtcaagtgttgagttcaggtcccgaatatctttgttagttttctgccttgatgatatgactaatactgtcagtggggtgttgaagtcccccactattattgtgtagttatctaagtctctttataggcctctaagaacctgtttcatgaatctgagtgctcctgtgttgactgcatatatatttaagatagatgtcttcttgttgacttgaatcctttaccattatataattccttttttgttttgttttgttgttgttgttggcctaaagtctgttttgtctgaaatcagaatagcaagccctgcttttttctgttttccatttgcttggtagattcttcctcaaccttttactttgagcctttggatgtcattgcatgtgagataggtctcttgaagacatcattcagttgcatctcactatcttatccaacttgccactctgtgccttttaattagggcagtctagttacattctggttagcctgtttacattcaaggttaatattaatatgtgtagatttgatcctgatatcatgttgttagctgattattatgcaaaactgattgtgtagttgctttattgtgtcaatagtctatgtacttaagtgtgtttttgtagtggctgataatcgtctttcctttccatatttagcactcctttcaagatctcttgtaaggcagatctaatgaacatgaattcccttagcacttgcttgtctgagaaggatcttatttctcctttgcttatgaagcttagtttggctgaatacgaaattattggctggagtttcttttctttaagaatgctgaatataggccttcaatcttttttggcttgtagcatttctgctgaatagtacactgttaggctaatgggatttcctttttaggtgacctgctccttatctctagctgcctttaatattttttctttcatgttgaccttggagaatctgatgactgtgtggcttggggatggtaatcttatatagtatcttgcaggggttctctgcatttccagaatttaatgttgtcctgtctagcaaagttggggaaatgttcatttatttttgtctaagttaattcagagaaccagtcttcgagttctgagattccttcctcagcttggtctattctgttgttaatgcttgtgatagtattatgaaattcttgtagtaagtttttcagccctatcagatcagtttgattctttcttaaaatggtcattttgtctttcacctcttgtatccttttattgtattccttagattccttggattgggtttcaacattctcctgaatctcaatgatcttcatttctatgtagattctgaattatatgtctgtcatttcagccatttcagcctggctaagaaccactgctggggaactagtgcagttgtttggaggtaaggtgacactctggttttttgagttgccagagttcttgtgctggttctttctcatctgcgtgagctgatattcctttaatctctgaagttgttttcctttggatgggtttttttttgttttttttttttttttttttttttttgcttttatcttctttgatgcccttgggggtttgattgtggattcagttgactggctttgattttgaagatttcagatggccaaggctcacctgagctctcctgagatgagtgtgctacctctgcggggctggtaccagacccccagctttgttctctgggccctcggggctaggaacctgctctgccagagaggccaaggtgttcccagtccactggcctcaacactacaatggaggtgctagccaaaacacttagtcggggtggtggcggtggaatccatgcttgctcgtgcatgccagcatccgtggcagcgtggcagcatacacatgcattggctcaggctgggtgctcgtaggagcctttaccttagttttcacaggtggtgtatactggcagaatattttagtgttgtcttttgggctgcgatccagtaggtggcgcttaagagtgttagccagcagatagcttcttgctctgctgcatggctccagggtaatggtctgtgaatggggacagggagatggcccattcacctagtccacccctgggccttggaggaaccccttctgattactggcttcatgcccgcatttcttttgttgggtgctctggtccacagggctccctcaggtaggagccacagttggcaaacaggtcttatccttactgggtcggccctgtggagggaggcacacaccacccctctatcaagctgcgaacctgggtgtctcatctctcagtgatgcttgggcaccacctaagtcagaaagtcccgcccaactgggagctgcgggagtgagtagtgtcacctaatctgctgtccaagtgcatcctgagggtaccaggggttgcaactgccagcagagtttaggcagaagctggaccactggactggaagctctaacaggcattgcccacctggctaccagtggtggagcgtggtggggtcacctgccctgcctgttgggtgtttccagtgacaacaggatgttgcagccactggctaagttcaggcagaagcgggacatctgggctggaagctccagcaggtgttgctcgcctggctaccagtgacaggagcaggtggggtcgtccgccctgccgtgtaggtgtttcatgggacaacaggaggctgcagcctctggccgatttcaggcagaagcggtagtgctgggctggaagctggcaccaagccttgtctggtgaggagggtggaccaatcctactgctcccaggcaccatgactttggcctctattggggctgtggcgctggtgttggtctgttccaggatccgaggcttgtagaggtccccttggacttaagagttgcctctgcaaaccgtctgggtggctctctgcctcagtttagaggtgaggtgggaggatgagagtggcaagtagggggttagggcaggggaattctcccactcccagccttacacagatccccatggagagtgtgaattaccctctcccgtattggggagcttctcctgactccgcattgatgccagataggctgctgcccagcttccctcctctctgctctctgtgtccccttgctgctttgatggttcccagtgtggtttcttagatgattggcttttagggtcagtgttcactaaaccctttgtttcccctccataagagagcagcacccatgatctgcttctagtttgtcatattggcccctcccatgctgggcaccttttttttttttttttttttttttttgagacagtctcactctgtcgcccaggctggaatacagtggcatgatctcggctcactgcaacctctgcctcccgggttcaagtgattcttgtgcctcagtctcctgagtagctgcgattataggcatacgccaccacacctggctaatttttgtatttttagtagagacagggtttcaccaagttggccaggctggtcttgaactcctggcctcaagtgatctgcctgccttggcctcccaagtgctgggattacaggcatgagccaccattcctctgctgggcactttaaatgacttctgtatccatgcttaaattatccacttctcgatgatagtcatttgtgatttctttcatctcacttgccagaaatgtgtctatcttattgattttttcaataaaccaactcttaattttatttactgagtctaccgggtttttttaattttctgtatttcatcaattctagcttttttctttacctttgctttcaaatttcttagatatcataatgattgtatcattagtccttcttcttcatggaataggataaaagtacatattttctaagcttattacttcttggattatgttttttggcatagagagggaatgtacatctcccaatgcctttgaagtatttaatagcaacctcacatgatgactagatatgctgcttatgtggcaagagaggaatatatggaataggacttagaatactgttacttatatttatagacattaagtggctgttctttggcagtgatttctgagtatgaagagatgaatatcaaagtacatattagagtagaattgaactagtctactactactttttaaaaggaaaaatagataataactttataatataataacttataataactttttattattcatttaagaagttaaaacacaaatattttcttctagcagagagagactctaaggtaattcaaagagaatttctttactgcaatgttaaaatctgtgtactaaattgcttttaatctttttaaagttgcgtgttgtatcacaagatgtgaaattgagccttcaagaattggatgaactttatgtcatctttaaggtactgttgttcttctttaaatgaaaaataatgcttttttttagcagaattgtatcacagccattctaattatttttatctttattttagcagacatggtttttaaaatcttccaaaattactttttctaattagtaactttccttttttatttatttttaatagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattggtaagatgatttttttaagcaaaaaaaaaaggtgctcctagaaatacttagtactgcctattattgccaatttagtcagattatatcaccatgggttacagtgtgtttagctttagtaataaatggacccttttctgcatttgttgctaaatctaagtattttgatattattttccccaaccctttcagaaaagcaagctgttagatgtgagtgttttaagggttaacataaggaagataacgtcccaattttcccacactcagatgcatgggtactaccgaaggacttcccccaccccaccgacctccccgtaaaaattcaaccacatagcctagaagagtggtagataaatacccagcaaacatgttgtacctacagatagtcaagatgttgtacctgtagatattgttcatttgcttttccagataccccagcatgctttcttatcagggatcaccccttgaagaacagttctctcctgcacaggcctcattcaaaagaaaagagaaatctgagattggggggaaggagctaggaaagagaacattttacttttttgataaagagtattttgcttatacagttatacacttgaaggagagcatctgattgactaggtggttgtttaattgttagcttaagtaacaggtttctaaatcctaatttttgactaatgtctatatcttaattaatctttgttgctgaaattgattgaatgttctttagatacatgattatttacaattgaattttattgaacagacataatgtacaatggaagttttactgagaagcttaagctgctttttaagctacatattcctccaggtaagagtttaccagtctttaacgatgtacagcaggaatttattccattttagcaagtataattacagatttttttaacaactaaactaattttcaacatgatataagatcgttgcttcactgtggccctcaaattatattatgactactttttgctgatatagatacagtgatcttctatggaagagattctgtgtaacatatgggcccacaagtttccttcctgttagtagtcaatttaatgataagtagtttgtatataagaatcacatatcatttgattgttggtataatgttgaattgttgttgttgtcattagagtggaaattaactttagacaaactgccaaacctgcgaaatactacaaattattcagaaaaatgggacaaggaagcagggatattaaatattttaaaaaggaagcacaataaacgctatcatttattaagcacctgctctgtcaagacattaactttacatgcatttttaaaatttaattctcataatatccatgataggtggcattatccttccaattttgatgataaggaaactgagagctggaaagataaaaatttgccaaagatcacatcgctaataaattgcatagcaaactgaagtctgactccaaagctcacatttctttatattcttccgtactacctcaaaattaccacaccattcagtttacttgtttttcccactgacctgaagaggatgccttgccaaagcctgatccctactttgtgaaaacagtcttaggctttaaactgaaggagcattgcaaaaagtaccttttagccgagatggggtagttcacaaaaacaaacagcacctcataatttgtttaaagctacacctgggatcccttttcagcttttctcaggatagccgggaaacattctttaccacaccaacaaggtaaaggccatctttaacccttcacacactcaaatcacaaacacatcattaaaagcaaaagacaaatcacctaaaaatttaattataaaaggagtttccattgtcaaatcaggctactgttagaatgtttaatattgtcatcaactatgcttttaacagagggataaaaaaataggaaaaacattatgtacctgttaaagcacaagtaggaagtaaaccaaagcacccaactttctgttttccttattattgaggatgttttttaaatggctgaggtcacattttcagagatttctaaatgccagatttaaacaatttcaacttttaatagctcttggaaaaccattaaaaaaacaagtaggaaaaaaatagaactcaaaatgatcaactacttcttgtatttactatattttatatatattacatatattacagtataattactatatattacagtagagtagaaccacttctgtatttcttcacttacatctttcttatacagaaactctttaacacccagttcccagatatacctgacccattatgaacctcatctctgcccctggttgttaataaatgtaatttgggttatttatatgttttcagcttacactgaagtgaaatctaaggatgcttcaaaaggagatgaactttccaaggaagaattactttatttcagtcagctgcatggtaaatacctgtttaaaatgttaactgttttgatgattagccacccataaagatcttgctgacttagatatactttacccaactaaaattgggcttcattttaacttatacttcttttgtattaccacagcacttagcatggtccataaatgtttgaccggttaaccaaattgcattttggtgctttgatttgtggaatttcttgcttattggagactcaataatgtattttgtttctacttacgttgcagaaatttctaaaatgtattagaccattttcatgccttgataaaatacaatagaatctttgatgattaaaggccatagctatttttcaaacagtgaatacttattataaatcactgtaggtgtaggagacagggatgagtctgtctccaagacaaaatttaaagtgatatgagtttatttttgtgtcctttagtttattttcataaatattcaatgtcctatagagggatgaaccctgattaatgtatatttgtggttattatatgttaaagtgtttgaacattaagtttgaagggaccttacaaatcatctagtcaagtctcttccttttatagataaaggcactaaggcccagagagaagtgacttgtgcaaggtttcacagtgagttgttgccacagtcagggctttgtagcacactcttctgacgtccagtatgtgctttttttctcctgataataaaagtaatataactttatttaaagaaagtcacaaagaagaaaataccacccagaaataaatacttaatatttggtatgcttccttctaagattttttaaaatacggattttcccccaatgttctttttactgtgaaagttttggaatattttgtcttctgatgataggtcaagtcagctaaaatttgtttgcagaattgaataaaataatgtgcttatacgtctatatgaaacattattttgctttcaaagagtatttgttaaacatcttacagaatgcaattacatcttttcttatagtttccaagcctgcaaatgagaaggaagcagaatcagcaaaacacagccctgaaaaaggtactatgatctaggagttatcatttaatttatttagttatttttatgtaaataaggatagctacaaagggggaaaaggtggattccttttaaaggctattgatgtctcagaaattatagaaaatatgatagtaaatgacccatattcatttaattttattatttttaaaagatttgtttttaattacaaaagtaatagataattcttagaaaagaaattcagacagtacataagtccttttgtcttcactcaaccctacccgaaaacatttttgtctatatccttttcagatctattcctatgtatacacaatatatgcagacatctctcttttttaaaaaaatattccataagtactgttttataatttcctttttggattttgcagtatatcatggacatcttttaatgtcagtacatttgtatcttaaactctttgaatgaataagtagtgtttcaaatttttgaaaaagagctactaaagaccactttgttttgtttgttttgagatggagtcttgctctgtcgcccaggctggagtgcagtggcatgatctcagctcactgcaacctctgcctcctggattcaagccattctcctgcctcagcatcccgagtagctgggactacaggcgcccaccaccacacccggctaattttcatatttttagtagagacagggtttcaccatgttggccaggctgatctcgaactcctggcctcaggtgatctgcccacctcggcctcccaaagccctgggattacaggcgtgagccaccgtgcccagcccactttggaacaatatatgcatattaagaacataatatagaagctgttttaaacttaatagtatacatgagaatgactacataaaatttgcattattaagtcggggtgtattgttttaatctaaatatgtcctttctccctctctcgccacatattccctagttcccaactttcctaaagtaaacgttttagtctaaacagaaatgggaaaagtattctgagagccagtgggtgaaatgaaaggtaatttcagatcatttcctggattaaaaaaatgggatcttatatctcagtgaaataccttttaatcataattattatttttgaattttgggaaagtatagtgggctgttccttatgaaatggttttactccctttcttcaggcaaagggaaaattgatattcaagcatatctaagtcaatggcaagatgagcttttcaaaaaagaagaaaacattaaggatttaccaagaatgaatcaggtatagcatttttaaaaagaaaattctaagttcttgcttttttgtatggatgtgggtgtaacctctaaaatagctaacatgctattcccaaaatagttaaataatctatctattagctctctaagtttcagatgagcatggaagagtgggaagaaattttttaatgatttttttatttttaacactcaaatgtgtccagtgtttcagagaattcttctgctgtgacatgtacctatagaaaaaaagtatgtgtagtatatttccaactttattggaaatgttcatttattcagtaaacatttgtttactgtataccagataccaaacccaatgctaggtactgggaatgataaattactgagatgggtcacaccctggttcctactgatcttatatctgaacataattttaagttcatctctttcttatacactgcctaatcaaaatatgttcttctttttgtaattaaaatctggttagtacagatactgaggatcccgagaactttaccaaaatgaaaactatcaaataacttcatatttctcagtggactatatcatttgacaattgaataagtactttctaaaatgagtcagtatgacatatttattctagaattactataaatgaacagtactattgtttagggaaaaattctctcaaactgccttttttcctctactctcacaccatgacaataacaatcatcaacatagaagaaaatgtctgtggccaaatgtgtgggggttttccccccaaccaagcagcagataccagctgagtgtcctccaattaaattccaacactatctacctagaaatagtatgagatcccacaggttgagtgttcagtccccaagactgctccctcctttcccccagtaacaagtctgagcctcctgaacttctggctgaccaacttcaagttggggttcccactatcccttctttgagttcgattaatttgctacagagagacttacagaactcagagaaatagttatatttactggtttactaagaaggatattttaaagaatacaaataaacagccagaagaagagatacacagggcgaggtctggaagggtcccaagcgcaggagcttctctccacgtggagttggggtgcaccaccctcccggcatgaggatgagttcttctttaccttcctcctgtcagcctccatgcattcagctatcagaagctccctgaacccagttatcttgggtttttatggaagcttcatgatgtcagcattccttcccctaagggtatgaggtaagaccctttctagggagggttttaagaccgactatcagaaagctactctggaggatgaggcaggagaatcacttgaacctgggaggtggtggttgcagtgagccgagactgcaccattgcactccagcctgggcgagctgagatttaaccattgcactccaacctgggtgagctgagatttcaccactgcactcaagcctgggtgacaagagcgaaactctgtcaaaaagaaagaaggaaggggaggggagggggagggggaaggaaggggaaggggagggaaaggggagagaagggaagggaagaaaagactgtaacaaaggactatgggagttgtgaactaggaacccagaaaaatatttatatatatatatatatatatatatatatatatggaattcaggattaaacatcttaaacaattcttaaacaaaagcctatgattctaatgtcagtgacttttcattccatggaagcaggtcaaagtgcagcctaatttatgcataattttaactatatttctgtccagaattcttgttcaccctctgaggacagcttcaaagggactttgcctaattagaagtaccacctggccaggcgcagtggctcatgcctgtaatctgagtgctttgggaggccaaagtaggagaggagcacttgaggctaggagtttgagatcagcccaggcaacatagtaagatcctgtctctacaaaaaatgtgaaaattagccaggcatggtggcatgtgcctatagtcctagctacttgggaagctgaggtgtgaggatcacttgagcccagcagttggaagctgcagtgagctatgattgcaccatggtactcaagcctggacaacacagcaaggccttgtctaaggaaaaaaaaatagcacctaacatttaagtaatgctggcaggcaaacagtccaggaattagtctggataaaatgtactattaggcaataagtgagagcacttaaatgaaattttcttccatggttcatactcatctttttttttaagatggagtttctctcttgttgcccaggctggagtgcaatggcacgatctcggctcactgcaacctctgcctccatggttcaggcgattctcctgcctcagcctcccaagtagctgggattacaggtgcctgccaccacgcccagctaattttttgtatttttagtagaggtttcaccacgttggccaggctggtctcgaactcctgaccccagatgatccacccgcctcggcctcccaaagtgctgggattacaggcatgtgccaccgcgcctggcccatactcacctttctagaaccaatatgtattttggggttaatcaccagttcttataacttctagggtgaagcttctatggtacaaatcctatataggagactattcacttctaagttctctttatatttgctaagtctaatattcaaacgtgatattttcaacttgtgtcttctagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttc

SEQ ID NO: 5798 - DNA, 15626 bp, human; identical to SEQ ID NO: 3596

SEQ ID NO: 5799 - DNA, 101314 bp, human; identical to SEQ ID NO: 3598

SEQ ID NO: 5800 - DNA, 100779 bp, human; identical to SEQ ID NO: 3597

SEQ ID NO: 5801 - DNA, 34214 bp, human; identical to SEQ ID NO: 3603

SEQ ID NO: 5802 - DNA, 34083 bp, human; identical to SEQ ID NO: 3604

SEQ ID NO: 5803 - DNA, 8525 bp, human
gttgaggctgtgaagggcactcttgatggacagcaggctgaactccaggtaagaaacaacaagacctcaaactgtcaattagaaagtaaataagccccatgctgcctagtgaaattgaaagcctgatagcgtgggtgccaactcaaatgaaagtaatcctctgatgtattgaacctccttctgtcccacttgaatacctggagttaatcctggctttctggtttggaagtcaaacaagaccattctggggcaagagtttgtgatttcagtaggtgtgaatgaatgaattataaatggctgcatttataatgcaagcaagaaaacacgttgatgttagaaaaaacgggagagaaacaaatagttttctctgtaaatgtactcttttcctgggatttttccctcaaaatccagctttctgccttagttttaaaatatattgactttctgcttaaaggagaatacatttgaattcatctagacaatatcttttggttttctaattgctttccctcttttattggcctgttaaggtaaagcccacagtacaaggaattaggaaaattggattccagatctgtctcaaccgtcaattttgccttttattttttaacctctctgggctttggtttcttctgtaaactgagggaagtgaattaaatgaactgtaaggccttccagtagattttatgaaaaattagtctcaccagactaagacaatacagtttattgaacaataacaatcacttgaataatatacatttacatgaaaccaacaaaacatgtacatagaaggtgtgtattatgaagggacctcaggaattacctaatccagtgatttcccagcttcagtcattcatgtaccatctacatgatttttgtcatatttgtgtatcaccagcactatttgttatttaatgttattttctgtattgacttgttttcttaaaatcttaaaaaatatctaccttaatctaccctatgcaacaatattcaggaagtcatagatttaatgtgctagatttttctgtttctaatacacattgaaatttgtaagttttcatttatatactacctaaaatcaacttaaatgcctatacttggtaaatacatatcatactttggaaaacattactctcttttctcattcagatgtggaaagtaaaggttggagagattaaataactttgtttcttatctaaaaccaggctgccatggaggcatgactagaggccacctcccctaactatatcacagtgaggggcagagctgtgactaactcaagccacctgacccctagaccaggaccctttccaccacatcatgctgctcccacagttgccattatgatctaagtatctatgctctttaatagaaatgggactagaatccagatcttaagtttaataagttataataataataaatgagcccttgtggcttcagatgggtcacttaatctctctgggtctgagatgccttatttgtttaaatgacagaagaattccagttctgccttctgccacatggggagaaagatggtagctatcattggctgagcacttccgaggtcctttactagatttcttagtttcatcttcacaacaccactataaagggatgggaccagatgatttctaagatgcttttccgctttgcttctaataaacaaaacaaacccaagtttgtctatccaaaagagtaggtgtgtctaaaaggagcatgaacatttgaacatttaaggaaaccagatagtctcactgggtaaggtaaattcaaattttaagaagtttataaaatggtaaaaaaaaaaaaatgatggttttggtttcccatcagacatttgtgttctacataatgagtttctctcaggtggattcattaagtgagcatcttgatctcctagcccaagcttaggtgttgaatcctgtcagctccagctgcctcctcctctgtaagataggcatactaatccctgccctgatgacatcacagagctgctctgagggccaaatgcgcagctgtgagcaaactaaagtgccccactgagttgagaaaccttggccacagggacctgttcctggtggggggaagatgctgcttctttatcaaaggtaatgtgtttagaagaagctttcaggtagcttatcctagtcctggactctctccagttctcacttctgttatttttctgtctagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttaggtatgagcacttttttctgctttttcttttcttggaaaaagttaggacactgaatgagccaggacagtgagttatgatgccaattaagtctctgtaggtaaatatactccctaatattttcattatcagggaaatagagacaagccaccagcccaaccaaaacagtaacactgagaaatcactcataaaacatgcagaacaattgtgcaaacgggctgccaaaatgacagcagtagatgacccaacctccagtgatccctatctctgagggatggaatgagaacagatgagacaatccactgtcccacaaaatgatcactagcaactcttttagaggaaacctccatttacagccagatctacctgggggagactactgtcaacttattattccttttaagctcgacacaattcccaccattaaattattcttttaaataaagacaggagagtcccttttttaaaatgctaatgttatttggaaaaaggactgaaattaatctagtgttgagaatcaacatatttacatacaaatattcattatatgatattgggcaagccgtatctgctcttaaaatgaatttggaatctcatttgttcagtatttattgagttacagtgatggaggtgttgtttttgcccttgggaagctcccaattttggccatttctagaagtccttacaatctctgtctgagaggacaatgtgggctaaacttccatctgcaggctggtattgggaagtatcgaagcaagggatgaaagggctgccaatcctcaactcttacagacagaccagttgagatgagcattttcccacttctaggtagccccaaatgaagctgatctagtcattgctgctctcaagctgtgtgcacacatcacaagaaaggaggaactacatcaaatcagtgacttaatagttgagtagcttggaaaagcagcaattggtaacaaggtgcatacccaagagaactgtttacagttgtcctggcttgccactcaggtaatgccacaaaggaaccagctgacatttactgtgaggtttgccactgcatctacccacctgggaaagagggaaaggtacctaagagctattttttaagagtgggttagcttaatcaatcatatttttatcttactgagttctgtgccaggaattggggtacaggaacagacaagagaagtattactcaagcaaattcctgggagagtttctgtttcagtttggaagactagtgtattagtctattcttgcattgctgtaaagaaatacctgagactgggtaatttataagtaaaagaggtttaattgtctcacggttctgcaggctgtacaggaagcatagcagcttcttgggaagcctcaggaaactacaatcatggcagaaagcaaaggggaggcaagatgtctcacatggctggaacaggaggaaggggaggggaagatgccacacacttttaaacaaccaggtcttatgagcactcattcactatcacaagatcagcaccgagggggaaatccgcccccatgatccagtcacctctcaccaggccctatcgccaaaattagtgattacaatttgacatgaggtttgggtggggacacagatccaaaccatatcaactagttagttatatacatgggaactaagtgatgtgctataaatgccaaagcatcaaactggcactcagaagacctgagttttagatcttactctgtactcagtgaccttatacaagtcagtccacctttctctgaccattgtgagatggggttataatttctgccctgtcttctttacaggtttgttatgaacagttttgttattttacctataaaatgaaatactggagatcaaaggggtttttaaatgttcaaaaactggagggattagctaatgattttctgttgcttcctggttctgggatgttctgaccagaaacaatctaaagaagccaagtctcttcatctcagagcttggaaatagccctgagataaagttagacaagaaggttaatattcttaaatttaaagctcagaggatcccaaatcaatttccataagaagttgagggtcacttcatctcagaggtgttttttcccatgagtctttgtgtcagatagctctgtgtcatgacttttccttaagcagccaggatccagacaaggtaagaggcagaagggtctgtggatttccttgtttgtttaggaactctaaaaaatattgtttttgttaattgggcaaagaacaaaggcctcctccaaatgtaggctttttggaaaatttgagactgctaattttctctaaaaattgcagcgactatttgcaattctcaaatctcattgtatatgagtgacaattttgcttgccctgactgaaaggtgaggcaagatggggacaggtgggtaagagagacaggttaattgtggggagaggtgttgatatttccttaaagatgactctcatagcaatgtatctttcagatgttttgttacccagcagtgagcatcaatcccatgcatttactcgttcatgcatgaattcatttaacaaaccctgagcacacgtgccagttactgtgctaagcaatggacatggggaaatgtaaaagatagggtcttagccctctaaaattcagtctagtgaaggagacagacgcgtaacataaaagctttcagtggaggtatgagaggagagctatgagggcacaggggaaagggcaaaaagctgtatcaggaattggagaaggcttattgaggaaagtgacttttgtgctgaatgttgaaggatgtgcaagagtgtgtgatgaagaagaggggctgagatggcaaggcacagtttaggtgaaggaaacagcaatgggcaaagaaccaggtggtttggatggccattcatttgagagctttccattaggtatgacaaccttggaaaattaatctctgaaaaatacccagatcaagtttgaataattattttgtgtgcatttggaatgagcatcatctaccttccgcaatttggcacataaaaagaaaatgattgatttagggaaggtttaagaacctactgaagcactttgttttttcttttttctttttttttctgagctgagccttttcctcccaccccaattctgttgaaagcaataaagctaaatggtagatcaatggctttgccagtaaaatacccaagttccactggggactttaactggatgaaatttcagttcaatcctgggtcagtagttttagaaaatatataggtttgggacttggttcaaagtgattcactaaatgttttgttaataaaaaataaaaggagaaaaatattctaagcaaaaaaaatgcctatctgggtttgattctgggctcaagaaatgagtgcaagtcattccaggtttttgccataatttagttcaagtcctggtgtccaactttgtgatgaaacacccccatttaattttctgttcaaattgttctattctgctgtaaaggctatacaatagccatctttttaaaaaggcagtatctaaatctagtgatagctgcaatggacttctggttaaatagcttagtttaggataggcacatccaacaagttgttcctacctgagaaaatctttgataagaaagaataaagaactaagtagaaggatattcctttcaattaaaaagacacatgcttaaaagatagggctagtaaactgtttaagaattatagctatatgcatctgtcttctcgcacctgtgtacagatagtgagagtctgggaaggctgaactgagcggaagtcaatgggagagtaactttagtagcaggaattagtgctgctgtggccaacagaaattccaggttctaggccctatatttattattgtatttaatacttggatcagccagaggttagataatctcttagtcacgttttacagatgagtcagctgaggtttggctaagttaggtaacttgcctatacagatccagggtagagttacaaagcccgtattctgtgtggatccagagctgtgcccttaaccactgcgtctcaggtaagagctgtaggactgagtaatatgacacatttcatgtctaactcacctaaattagagaacctaagctttaaagggttctagagcaaaatgaagataagcaaggtgagttggaaagtatagaaatttacatcattgtctgtatataagatagatatataaggtgtataagatagatgtatagatataaaataaatatctaagataagagatataagatagatatgtagatatgatagatatataaatgtataagatatgtaagatagaataaaccgtgcaagtaagtaagatgaatgaggagattcagattcccagcttcccacaggacttctcccctgacatgttttcataagcagctaaaactctatgtcccggactgacctcattagtaccccttcctccttgtcaccccttcacctaaaacctgttcttcctgctgtggtcttggaggcctcttcccctctctaaagtcatctctcatccctctcccaccccactttagaactgtgtgaaagttacttttgaattcctggtgcctagtcccatgccaggcccacagaaggcatgggtgcttgctgagtgaaggatgaataaatatttcagtgctgagtagcgtgcaccccccaaatggacttcccctactgatgatgcacacaggcaaatttaaacctttcaactatttgtgtcacccacagatgaacaaatgcaaaaaaaaaaaaaaaaaagaaaataatcatgagagaaaagagaaatacagcattaaatattttaaaaagaataataggttatctcagagtatttaaggattctattttcctttaaaactgtgcttttaaagcataaactatattcctggtcatttagtatttgcttatatttggctgttttaataaaggcatattttaagacacaatgcggaaattcatggttataaatctgaggaggaggcagacagaggagtcactatttgaatcttaatggcctcttgactagaagggccctgcacctgaagtgctctactcccacctggtggtgcaagcagaaaactgccaacatacattttaataattttttttgtgtgtgtggagacccagtctcactttgttgctcaggatggagtgcagtggcgtgatcttggcttactgcaacctctgcctcccaggttcaagtgattctactgcctcaccctcccaagtagctgggattacaggcgcccaccaccacgcccagctaatttttgtatttttagtagagatggtgtttcatcacattggccaggctggtctcgaactcctgacctcaggtgatccacctacctcggccttccaaattgctgggattacaggcatgagccactgcgcctggccaagaattttttttaaaaataaataaacacacatattattcaaaatgaaagtgaggaagtgactgcaattgtcacagaatgccattcatcctaaagaatttttattctttgtcattgccttacagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcagtaagtgtaacctgcagtagaccctggaaaggcctggtgtctgtggttggatgacagcaggagtgtgtggttggctgcttgaccttacagttcaatcttcttgttttctcagtggtggcgggtggaggggggcggctggtaatgtaaaaagaatgcctgtctcccaacacgatgattgtgttctggtctactccccaaattctaaaagccagctcagagatggtgaatatgtagggaacaggcatggtcccaggtgagttagcactggaacagtcctgaggggcctagttgaatcctgaacatctcaagaaagagaggccaatatgggggagtgggtggacattgagtgatctgttacactgatgttatctgtatgcacagaagagatctcaaaagtctattccctggtttcaacagacccaaccaccggga

SEQ ID NO: 5804 - DNA, 282823 bp, human; identical to SEQ ID NO: 3611

SEQ ID NO: 5805 - DNA, 282823 bp, human; identical to SEQ ID NO: 3611

SEQ ID NO: 5806 - DNA, 283865 bp, human; identical to SEQ ID NO: 3612

SEQ ID NO: 5807 - DNA, 283865 bp, human; identical to SEQ ID NO: 3612

SEQ ID NO: 5808 - DNA, 282820 bp, human; identical to SEQ ID NO: 3607

SEQ ID NO: 5809 - DNA, 282820 bp, human; identical to SEQ ID NO: 3607

SEQ ID NO: 5810 - DNA, 282539 bp, human; identical to SEQ ID NO: 3610

SEQ ID NO: 5811 - DNA, 282539 bp, human; identical to SEQ ID NO: 3610

SEQ ID NO: 5812 - DNA, 282281 bp, human; identical to SEQ ID NO: 3605

SEQ ID NO: 5813 - DNA, 282281 bp, human; identical to SEQ ID NO: 3605

SEQ ID NO: 5814 - DNA, 282281 bp, human; identical to SEQ ID NO: 3605

SEQ ID NO: 5815 - DNA, 282281 bp, human; identical to SEQ ID NO: 3605

SEQ ID NO: 5816 - DNA, 225680 bp, human; identical to SEQ ID NO: 3609

SEQ ID NO: 5817 - DNA, 225680 bp, human; identical to SEQ ID NO: 3609

SEQ ID NO: 5818 - DNA, 170788 bp, human; identical to SEQ ID NO: 3608

SEQ ID NO: 5819 - DNA, 171855 bp, human; identical to SEQ ID NO: 3613

SEQ ID NO: 5820 - DNA, 175149 bp, human; identical to SEQ ID NO: 4916

SEQ ID NO: 5821 - DNA, 174693 bp, human; identical to SEQ ID NO: 4913

SEQ ID NO: 5822 - DNA, 174670 bp, human; identical to SEQ ID NO: 4914

SEQ ID NO: 5823 - DNA, 174557 bp, human; identical to SEQ ID NO: 4915

SEQ ID NO: 5824 - DNA, 174673 bp, human; identical to SEQ ID NO: 4912

SEQ ID NO: 5825 - DNA, 106410 bp, human
tggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaaggtgagtaactttactgctggatcaagggtaaaaaatattagctttgtttatttcttggactgctcctgaggggtgggatggggagtggggataagtcgatgtttggataattgaaatttcaagtctgtaatccttatccaaaaccattaagatcagatatatttcagaaatcagaatttttttggatttcagagaggccgtacagtgcatgtagagtcttttacatacactcccagtggggtttgaggcagtaccccgcaattaaatacattattatttttatgggaaacatatgaatattcaccgtaagtggaagaaataaagtctataagtagcctaacctcaattcaagtcgtattttgctgtaacattagctttgaagaaaacaaactttcagtttttagagctttttggattttgggattgccaacaaaagattgtggacctgtaattatcatcggctttgtatgtttaatgaaattgatcaagggaaaaggcacattcttgacagatatttcctttgatgaggtatcatgcaggtgatggactcctgactgtgttctttttaagaccctttctcattttcattcttcttcctcttcttattggcagggattcatgcaggtgtctttccttatagtgatttttcttataatacccttttcttctaaatatggactccgagagaacagaagaaccacatactaaagaacatacaagtgataaagccaacaagtccataatgcagatatcctatattaataagagctctcaacaatatagggacacatgtcaacgatttctaaaccacaccattaagtcactacaggtgaagaaactctacaaacatgagtttcattcctttgtcaatcctcagttctgctgaatgtttttgactcctgtagtagttcagtccaagggcaaaaattcagcatctcaggctaccaggagtgattgaatctcctgggacatttgtgaaacatgaggatttctggagtcccatacttggggaatcagaattcttaatgggggaacccaggaatttgtatgttttacaagctctgcataggacttttttgttcctcttgatgtttgagcaccactgcatgggggaaggtcaaactgccacagctgcaggtttccaaaggctgtaatctgggcccatgccacaccaggtatcagggaactgatttgtctgttaggacaaggttctttttgtttggttttacctgggaggagaatggaagagtaaaaccacctagacgtgcttagaaacaaaagaatcaatcaaagggaggcttggaacctgcgggtggcagtttgatagggttgccagctaaaataaatacaggacatatttatactaaaactattcattgtttatctgcaattcgaatgtaactgggcatcctgtatttttatttgctaaatttggcaatgttgagtattgataaacccaccttctcccctgggaggcaaaccagatggcatggtgtgtgcgtgttccatgctcagaatctatttttacctgccctgggttaaatttaagactgactacttgtgtcgtattgaaactgaagcattgaaatattgagtcttctcaccctccttctccctttctcatgtgtgcgcacacacacacacacacacacacacgcatgcatgcatgcaagcacaaacatgtacctgttgcctttaaaaatttttatattacattattgtgttagagttttggttattttttgttattgttaaagtaacattgtctcactctgtctggcattttttcttgctaaccattcttaattcttcttcaattgcagatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaacaggaaataaagagcccagcagattcttggataattgagaatggtgtaaatggctttctgatttacttaagtcattaaagtgttaggtaggggaaaaaggaccccatttgctgcttcaaatagctccctgaaatagccacttagtctcttgccttaggtgagtaactttcagctgcgtgagggataatggatcctgatttcatgtatttcttacttgaacagctcctaaaggaaaggggtatttaaccctgttttccttccttgattttccaaaatgagctcaattattcagtgtaatgttttaaaagtaacatttattggttctatttcattatgaaagtaacaattctcattatggaaaacacagggacacataaggaagaaacatcatccatcccaaatccaagcaccaagagataattttgcttattacctttcttttcttaagaagcagagatcatattgtatattgaggtgtttactgtatcttttctaaatttaacttggtttattgatacattcatataggtgtgtaaatcataaatatgattgctggatttttttttgtagtggtcctttcttttccctttttttcttcagctcctagttctacctttccacactatccctttgtattaccaaaacagtatgtatcttttcacattttactccatgtgcatagatatacacatgcatacacacatacacacacaagttttggaatgttttgttgttgttcattgtttgttttacagaaatagaatattatatatactttaatatatctttttcattctacaatatctcatagaaatctatcacagtctattgatgtagctcttattcttttataatgttgtaaaatattccatgaatgcacaataagttattcagccattcccctattaatgaacatttactttctttgcacatttctgccactacattcaatgcttaaatcaacatgattttgtatatacccttatatactgttgctttcagtttagatatagatgtaggtagaggtatataggtatatgggaatgtttaaatatatatttatgttaatagatatcgccatattgatttataaaaacaggctgttatgctacactttttgcttttgtatgtaatatgtgagattattattttcttcttatccctatcagcaacaggtgttaatggttcttttgtaattttgacaacctaatggatgcagtttcttggctactagtgagtttcagtattatctcaattttttgtccaattaaatttgttcctcgagttgtctattcatattatctgcacattttcctatgggttgtttatatttttctaatttctaagacctctttgtatattttagattttagccctttgtctatcatcattgttacagatacctttcccaaatatgtttatattgacttttttttttttttttaattatttttttagtagagatggggtttcaccatgttggccaggctggtctcgaactactgacctcaagtcatctgcccgcctcggcctcccaaagtgctgggattacagatgtgagccactgcgcccagcctatactgactttgttgatggaatatatttccatataattgtttgcatttttatatccaaatatgactcttttcttatatagcatctgaatttcaagtcttggttaagatagttttcttgaagataggtagccagttgtattggaataatatattaaatgatccctattttaccctgtgatctctttgcagctattaaatgttttatatgctaggatctacttatggattctctattctgtttcttctttttgtctatttgtgtacccaaatctcatatatttgattacattaggctttaaaaaatatttttctggggccgggcacggtggctcacgcctgtaatcccagcactttgggaggctgaggcgggtggatcacttgaggtcaggagttcgagactagcctggctaacatagtgaaaccgcatctctactaaaaatacaaaaattagccaggcatggtggcacatgcctgtaatcccagctactcaggaagctgaggcaggagaatcacttgaacccaggaggcggatgttgcagtgagccaggactgtgccactgcactgcagcctggggaacagagtgagactctgtctcaaaaaaaacataaaaaaaattcttggctatttgttgtcacttgttcgtacacacaaattttaagatcacttatattcacctacctctctcaaatactagtggaattctaattagaattgccttaagtatatatttcagtttttaaattatatggctccttttatctaagaaatggtatttctttccatctgttcacgtcttattgtttcagttagatttatctttttcttcatatctgctctatgcctttcttgatgcatttattcctcaagaattaacagcttttctgccaggtgcagtgactcacgcctgtaatcctagcactttgggatgctaaggtgggcatactgcttgagctcaggagtttgagaccatcatggacaacatgatgaaacctcgtctctaaccccccaccaaaaaaaagaattataaaaagaatagaaaaagaattaatagcattccccctctcccccaaccacgccgtaatgagtggaatatttttcccctttctattcctaagtgctttttgctagaataggaaaagattgttgatttttaaaaatatcttatatctggctatcttaccgaattctcttgttcttgtaaattttattttagttttatctcttcttttccttagttataccagttatttcattttcttgttgcatttgctagaaattcagagttaaataaaaattgtgctgacgggctactcttgcctaaaactgattttaaatggaaatattttctgtactcctccatatttgctgttggtgtttgttaatagtctattatacttaagtagtttttacatttatgtagagatttttaaatatttatttatttatttatttatttatttatttatttagacagtgtctcactttgttgctaggatggtcttgatctcctgacttgaagcaattctcctgcctcggcctcccaaagagctgggattacaggtgtgagccactgtgcccagccaagattttttaaaagaaggaatggtagctgtattttatctaatgctttttctacatctattggtcatgtgggattttttcatttaaatttttgatataataaattacattgatagattttctggttttgaactactcttacattattgaaatacacccgctgatcatagtatattattattttgatacattgctgggttctatttgtcaatattttatttagaatcttgcttcaatattcccgagattagagtcatgtttttcttagtgtttttttcttcaagtttaaggattgaggccaggtgtggtggctcatgcgtataatcccaacactttgggaggctgaggtagaaggattgcttgaggccaggaattcgggaccagcctggacaacataccaggactttgtctctacaaaaaaaaaaaaaaaaaaaaaaattaaaattaaaattagcagggcatggtgttgtgtgcctgtagtcccagctacttgagaggttgaggcaggaggatcacttgagcccaggagttcgaggctgcagtgaactatgattgtgctgctgaactccagcttgggctacagagcaagactccatcttttaaaaaaaacaagtttaaggattaaagttatggtggctatgtaaaatatactgcagaatgttccttctttttctcttgtctggaatactttaactaccgttagaaattatgtatcctggctgggcgtggtggtgggtgcctgtaatcccagcactttgggaggctgaggtggtcagaccacctgaggtcaggagttcaagaccagccttaccaacatggtgaaaccccttctctactaaaaatgcaaaaattagctgggtgtggtggcaggtgcctgtaatcccagctactcgagaggctgagggaggagaatcacttgaacttgggaggcggaggttgcagtgagatgagatcgcaccactgcacaccagcctgggcgacagagactccatctcaaaaaaaaaaaaaaaaaaaaagaaattatgtatcttttaaaggtaagataatctgtgaagccatctggtcttggtgccatttttcaatgggtaaacccttaatcacctttctgatgtgttctgtggtaatctattcaaatctttttgggtcaattttggtcgtttgtgttttgctgggaaattatccatttcttctaaattttcaaatttgttgccaaatatttagttgagcatgtagtatcctcttattttataatttaaaaatatctccttatctgtagtcatgtattttttcttggacttgatcttgtctgtttttgtgttctctcctctgtatattaatcaggttagtaagcacttatctgtttttggttgctacatagaaccatgttttcaatttatttattctttctaccttatttattttttctacttaattttcagcttttatcttcattaattccctcttctgtttttttcttaatctctcaagcacaaggacaagtatttattcctttatttattttttgtctttttttttttccaatttttcttctagatccaagggttacatgtgcaggtttgttacaagggtatgttgcacgatgctgaggtttgggacatgattgaacctgtcactcaggtagtgatgagcatagtactcaataggtagtttttcagcccttgtcatcctccttccctcccctctcttgtagtccccattgtttgttgtttttattttatttttattttttgacaggttctcactctggtgcccaggctggagtgcagtgttgagaacgtggctcactatagcctcgacctcttgggctcaagtgatcctcctgcctcagcctcccaagtagctgggactacaggcactagctgtgacacctagctaggtaattattttagtttttgtagagatggggtctttctgtgttgcccaggctggtctcaaactcctgggctcaagaaattctcccacttcagcgtcccaaagagctgggattacaggcatgagctactatgcctggcttgttttaactatctttatgtctatgtgtatctaatgtttagcttctactcacaagtgagaacatgtggtatttgattttctgtttctgtgttcgttagcttaggataatggcctcagctgcatccatgctgctgcaaagggcatgacttcattctttttatggctgcatactattccatggtatacatgtactatattttctttatccagtccaccattgatgggcatctagattgattccttgtctttactattgtgaatagtgctgcgatgaatatacgggtacttgtatctttttggtagaatgatttattttcctttgagtatatacccagtaatgggattgctgggttgagtggtagttctgcttttaattctttgagaactctccaacctgctttccacagtggatatgaactaatttacattcccatcaacagtatatatgcattcctttttctctacagcctcaccagcatctgttatttttcaaatttttaataatagccgttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttactcaggattgctttggctatttgggctgttttttggttatctatggattttagaatagttttttctaattctgtgaagaatgactttggtagtttgataggagtagcattgaatctgtagattgcttcgggtagtatggccatttgaacaatgttgattattctaatccatgagaatctaatacttttccatttgtttgtgttagctatgatttcttttagcagggttttttagttctcctcgtaaagatctttcatctccttggctggatgtattcctaggcattttatgtttttgtagctattgtaaaatgggattacattcttgatttgattctcagcttgaatgttattggtgtatagaaatgctactgatttttttatatgattttgtatcctgaaacttcactgaagttgtttatcagttctaggagccttttgttggagtctttagggttttctaggtatagaattatatcgtcagtgaagagaagatagtttgaattcttctttcctatttggatgccttttatttattcctcttgcctgatttctctggctaagccttccagtactatgttgaataggaatggtgagagcgggcatccttgtcttgttccagttctcaaggggaatgcttccagcttttgctcattcagtatgatgttggctgtggggttttcttagattactcttattattttgaggtatattctttcaatgtttagcttgttgaaggtttttatcatgaagggaagttggattatataaaaaacctttttatttgactattgagatgatcatatggtccttgttttaaattctgtttatgtgtcgaatcacatttattgatttgcatatgttgaaccaactttgcatcccagaaatgaagcctacttgattttggtgaattaactatttgatgtgctgctggattcagtttgctagtattttgttgaggatttttgcttctatgttcatcagggatattggcctgtagttttcttttttcactgtgtctttgacagattttgttatcaaggtgatgctggctttgtagcatgatttagggaggagtctctcctccttgatttttttttttttttttttgtaatagtaagattggtgccagctctttcttttttatccatctgatagaatttagctctgaatctatctggtccatggctttttttggttggtaggttttctttttttacaattactgattcaatttcagaacttgttatttgcccaaggttttagtttcttcctgattcattcttgggaggttgtgtgtttccaggaatctatccattttctctagattttctaatttgtgggcatagaagtgttcatagtagtctctgaggttctttcatatttctttgggatcagttgtaatgtcacatttgtcatctctgattgtggttatttgggtcttctctcttttttctttgttgatctagctatcaatttatagatcttgtttatcctttcaaataaccaacctttttttattgatccttggtatggatttttttgggtttcagtttcattcatttctgctctggttttagttatatcttttcttcttgctttggagttggttcttgttttctagttcctctagacacaacttcagcttgttaatttgagttctttctaacttcttgatgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtaattgggtcttcttggtattgatttctatttttattccactgtggaacaagagtatgcttggaatgatttctagctttttgaatttattgagacttaactttatggccaaacatatgtttgatcttagagtatgttccgtgtgcagatgagaagagtgtttattctgtgattgttgggtggagtgttctgtagatgtctattaggtccaattggttaactgtcaaatttaagtccagaatttctttgttcattttctgacttgatgatctgtctaacaccatagtggagtattgaaatccccattattattgtgtggctatctaagtctttttgtaggtttcaaagtatgtgttttatgaatttgggtgctccaatgttgggtgcatatatattcaggatagttaagtctccttgttgaattgaagcctttaccattatgtaatactcttatttgtccttttttactgtttttggtttgtagtctttttatctggtataagaattatcgacccctgttcttttttgtttttcatttgcatgatagatttctctctatcccattactttgagcctgtgggtgtcatcacatgtgagatgcttctcttgaagacagcaggcagttaggtcttggttgtttttatccatcttgccactctgtgccctttcagtggacatttagactgtttacattcaacattaatattgatatatgaggttttgttcctttcatgatgttgttaattggttgctttgtagtctcgattgtgtagttgctttttggagtctatgggctgtgtactaaaatgtgtttttgtggtagcagatattattcttttgttcccatgtttagaactcccttaaggagctcttgtaaggctggtttagtggtaacgagttcccttagcatttgcttgtctagaaaagattttatttctccttctcttatgaagcttagtttggtgggatatgaaattcttgtttggaatttattttttctaaggatgctgaaaataggcccccagtctcttctggcttgaaaggattctgctgagaagtctgctgttagcctgacgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaaaagttcacagaaaatggaattaaagataaagataaaaattataaacttcatttctcaacagaagctccgtgaacgtcaatttaattcatccctaaagaatgcaatttaattcatccctgaagaactgagggtactgggaatgtaactgtcaatgtattcttttttacattattaactaaagataaatgagggcctttaagatatatatttttttaagtttaagaaacaaaaagaagtcagaaagagccatgtcaggactttgagatgattgcctaatgatttcccgtcgaaactctcagagaattgcccttgtttgatgagaggaatgagcaggagcattttcctggtcaagaagtattccccggtgaagctttcctgggcagtttttcactaaagctttggctgactttatcaaaacactgtcataataagtaggtgttattgtcctttgactctcgaaaaaatcaacaagcaaaatgtgttgagcatccccaaaacctgctgccatgacctttgctcttgaccagtccacttttgctttgaccggaccactttcattgcttggtagacattgctatgattgtactttgtcttcaggatcgtgttccatctcctgttataattctttgaagacatgcttcaggatctttatcccacctgtttaaaatttccattgaaagctctgtcctcatcttcagctgatctgggtgcaattttgaaacccatcatggggaaagtttgctcatctttaatttttcagtcagaattgtgtaagctgagccaattgagatgtctgtggtgttggctatcgtttctgctattaatcattggtcttcttcaattaagaaatgaacaagatacgaattgatgtaggtagtctgccactgcaggcttcatcatcaacatctcaccctttcttaaaatgatgacactctggggactgctgtggggtagggggaggggggagggatagcattaggagatatacctaatgctaaatgacgagttaatggttgcagcacaccagcatggcacatgcatacatatgtaactaacctacacattgtgtacatgtaccctaaaacttaaagtataataataattaaaaaaaatgagttatcctgtaaactgctgatttcttctgggcattgtctctgtaaactttttataaagcataaatgatttcaccatccttccacccaagcttcactataaatttgatgtttgttcttgcttcaattttagcagaattattgttgttctggtaggggctcttttcaaactggtgtcttatccttcttagtgcctcaaactagatcctgttcagacatgttagaataagttagcacgagtttattttggtgctgaaaatttgaaatccatgcatagttttttgtaataatatgtatttcccattaacttattgaagacctgttgtctattaagtataataatgtagaaaaaataatataggaaaaaacacaaagaaatcccatgtaccttttacctaatttcctccactggtaacctctggcaaaactatagtacagtatcactgccaggatattttcattgatacggtctgataaagcagaacagtcctgtcaccatgcagatctcttctgtcattcttttatagccatacccaccatctacatatctaaaccccatccctgatccctggcaaccatgaatctattcttcatatctataattttgctattttaggaatcttgtgtaaatatagttataccttatattacctttgaggctgactttttaaaaatcacctagcataattccctggagagttatccaactttttataatacacaacatttttttctgttttcgagaccacgttttgctctgttgcccaggctggagtgcagtggtgcattcacggctcactgcagccttggcctgcttgacttaagtgatccttccacatcagcctctcaagtagctgggaccacaggtgtgcaccactatgcctagctaataattttttttttttttttttttttttttttgtagagacggagtctcattatgttgttcacactggtctgaaacttctggcctcaagtgatgctcctgcctcggcctcctaaagtgctgagattacaggaatgagccaacacggtggctgatacacaccatctttaatgggtgcatattattccattgtgtggaaataccatgttgagttaaaaatcagtattttaaaaagtagagagcccttaaaatactttaactttacattagtattgttctttactgtttaaaagttctttgctttaaattttctcatctaatctttaaaatagtattgggggatagcgaatacattatccatactataaatagagcagtaggggaccaagaaatattatataacttggctaagattacttcgtggcagagtcaggattcctattctttcttctcttgccagtgatcataacataatcaggtttactgtgtgcctaggcatggtgggaaacacttaacattgattattttatttaatccttctaacaaaactgtgtgggaagtactaatagtagtactggtactattaatagtagtttggtcaagagaactggggctcagaaagtttacatgactggatgtggcttgcatgtggtacatgcaggatttgatccaaagtttctctcactccagagcccatgctgctaatcatgaccttgtgttgctgaagtgaatattttctactatcccattgttgtttaaattgttaaaagtatgaaagcatcttatttaaaattccctatgtctcagtatacatggatgagctctgttgtgatctttatgcccgtgtgttctttgggtttgttgactagcatcatatacctatctctcttgctttctctatgggccctttgctgtgccagccacacatgagtttaccagcttcccagctaaccaggggccagcatgttcttcctggaggcatgcccagccactataggaaaggggtatgacgtgtgcagcaggctgcatgtcctgtgcttggcaaaggctggcaactcccactggggtggagaagggacaggattctccacatggttcccatggtacacttgacaagagggaatgatagtaccacagtgttatgtctgggtcctggaatgcttcatttatatgtacctcagttgacatgtgacttgctcagtcctgctgctatagcctgctgctggaagggctgcctcagtggaaagcatgcatccagggtgtggagccaaaattagaagggccaaaattctacctggcccactaccacagcaaccttgggcatcgttttcttttgatctctagtatctccaactcctagaattccagcctggcagtcttctgcctctgaaggcctcttatccttcctgttcttggctcctcttctctgtgaatgcttacatagcagcgtcagagttgtttgttgtattgtgtctgtacatgcagtgctgttctgtatctctttgaatctgagccattttcttttgactcatttggctgatgtgaatggtactttcctgaagagctatctaccagtgccgttgacatccaagccacagaattcttttcctcacttcggtttgaataaaaccaacatatccttagggatggttttgcacttactatcctgctactaacttggaaaaacgttacatgtctcattcatcttagggaaccgacccagtcccaaaatatgaactagcctgcctcaccagttattaacaaataagatttccttttgaaaacctcagggataggataaaggactgtgttgcagtgtaaccagacctccccctcaccccccagttcccccaacacatctcacatctcactggtggcttctcttttctttttcccttgccttttgtgtcagtttttttttctttcaaatatcattatgggtaatttggaacatatacataatatggtggttacttatatctattagctatttacatattttattctgtagattgtcagctcatggtctctgctgaattttgatgtacaggtgtttcccttgttgatttgtatgagttttacatatataaagagtgttaatcttttatcacttttgcagtaaatgttttccccagattgtcttctaactttttaatgatgcttttgataatagatttggtttacatttttattggtcaaattgattgatttctaaacccccttcagatcatggtaatttcttccattgcttttacacttgaaaagacatttcccattctaaggttagaatgggatttaaaacaatccagttttaaaatagttttaaaaatatttaacttgtcagtccatcaaaaattcattttgtgactagtatgaagtagagtatagcttatattttcccctagagagtcatttatttgagcaccattcatcaaataactattttcctatgattattgctattatacttttatcatacataaattcttctatatgctaggattttttcagcttgtattattcattgatctctctcttgggttttccatcagtttcatacccttatatatgcaacagctggtaaaccagatttcttttgctttctctgcagcctagcgcattacccacacttttttcttagctagtctcaaccattttttcgtccaaatgaacttagaatgtttctgtcaggttctcctcaaaatcctaccaggattttgattggaactactttaaacctaaaatttcattgacatcatcacaacacagagtctgtcatccaggaaaagacatgatatgttaatttattaattttcttttatgttccttagttgctcacatgcatgtgtgtgtatctcatatatttctcatcaagatcatccctggatagttgatagtttatgatatttattatattttcaaactagttattactggtaggtaggaaaatttttgattttgtgtgtctatgcttaattcttatttctaatagtttttcagttgcttctcttggattatttttgaaattaatcacaccagctcccatatgataactttatttccttttaaagaacaaaactgctgttttgctttcaaacctgattgtattggctagatcttttgggataatgttaaataatagcagtactagcaggagtccttgtcttgcttctgattttaatggaaatgtttctagtgattcacttaatagaaatgtttctaatggttcatattagttggctctgatgttgtctgttggtttaagttagatgttttttataatattagggaattaccttattcttaaattatcaagtcctcacaaaaatcaagaatagttggccaggtgtggtggctcacgcctgtaatcccagcacttcaggaggctgaggcagaaggatcacttgacatcaggagtttgagaccagcttggccaacatggtgaaatcccatctctactaaaaatactatatatatatagtatagtatatatatagtgtatatatatatagtatagtatatatatatagtgtatatatatatagtatagtatatatatatagtatatatatatatagtatagtatatatatatatagagagagagagagagagagagacatggtggtgcatgcctgtaatcccagctactcgagaggctgtgggaggagaatcgcttgaacccaggaggtggaggttgcagtgagccgagattgtgccactgcactcagcctggttgacaaagtcagatctgtctccaaaaataaagaatagttgttgagtttagctgatgttttctaggaatctattaagaggttcatttgtgttttctactttgatctccccatttggtatattatattatagatttcctaatatcaatctttgttagctttctaagataaattttccttttcctttgcatgcttgggagagcctcagatttggcttccatactattaatttgattgattttgctctctgctgtctccaatgtgaaatttatttatttttgttacaatgttaatttctctgtatttctttctagctctgttgagctacttaccctaggttgtctttccttctcaatgttttattctagtggctttctatacctgtttcatagagtccatgttttctttcattctattgaggatgtaaacagttttctaaaatatttcttctggtttatacacaaaattaagacgtttttgtttcctctgagttgtcagagtgatatgcattttccttgtgctgccagaggttttcatatgaactttttttttttttttggtaaagcaacagggtcttgctctgttgcccaggctggagtgcagtggcatgttcatagctcatggaatcctcaaactcctgggctcaagtgttcctctcacctctgactccaaaatagctgggactacaggaaaacaccaccatgcttggctaattaaaaaaaatatatatatatatatattaaaacagggttttgcggtgttgcccagtcttgaactcctggcctcaagtgatactcccaccttggcttcccagtgttaggaataaaggcatgagccaccatgcctggtcaggttttttgtatggtttatgaatattcaaaaaaggatctgtctttcatcaaatacagggtatgtagattgcctttgactatcctcaagctcagattctctctcatattggttagaacccttttcagctccattgttggcaggcaggttgatacacatagcttttaacctgtttcacagtgtctgtcagctactcatctagtgggttctgctggacccatatggaatcgtctacccctactacaatgttctcagatgctctgaaccagataaactatgtgaaacagtacagcctcccacatgtgttactacctgagtgttacttgtgagggctcccactcctagcacacagtgtgccagtaccaattctgccatttctgcccttttgattttggggaattagagtctccatgtgaatgtagaccagttttgagaattgctgatttcctctgcaagtagtaaccacgtagtccaaatggatgtccggtttgccagtttctagatgaactcttggcttctaagccatgaggctgacagttgtggaaggactcaatgtttcctatcttcttttaggtttctgtgggctgctgcatgaattggccagattgttttttctcatttcagtattaggcttattgttaatggagatttctcccagatcctggtaataagttggccatcagtttaagttttcagtgtttggggaattttatctttttctatatcttgataggtatttgagtgggaaattgagagaggctatgttagtgattgctagccaagtgctattttaaagtagaaatccagtgtatattttagattagagcagagattggcaaccatttcctgtaaagggccagagagtaaatattttagactttgcaagccatatgatctctgtgttttaactatttaactgttgttggagcatgaaagcatcacagaaaaatgcaaacaaattagtgtggttgtgttcaaataaaactttatttacataaacaggaggaccagatgaaaaagttctggagatagctggcagtcatggttacacaacagtgtgaatgtacttaatggcactgaactgtacacttaaaagcagttaagttggaaaaaattttatatatatatgtatatatgtgtatatatgtatatatgtgtatatatgtatatatgtgtatatatatgtatatatatatgtgtgtgtgtatatatgtgtgtgtgtgtgtatatatataaaatcatgccaataaagaagccaaaacagaaaaaccatattttgctgactctgagtttagaggaattagatctagcataggcagagagagagaggaagaaattacatatgtacagtaggacagtgactctgttaataagctagaaggcagtgggagacatttgagtatttaagaggaataccataatggggatggtgagatcttggaaagctacaattcatcctagtgatgtcatcttatgatctttacagatggagatacacaagagttcacattcacattctttgacataaggatcagagtagggcttttctacttctctagaggcttgagaaacctctgcagctgtcagaagtgttcatatcagaaacaaaagctaaccagtcatttctttttgcttgtagtacaaatggtgactagtgatgcttctggtagttgatctgagctcttcccaggactagaagatcctagcattttagttattaaccacagcacacttactcaataaaagagcagtcatcagtctgagtcaactgtttatacagcctccagcctaagattcttccttatcagctagagacctgggcttaagaatttcacaatgggctgggagcctcttagagaaactagccttttgagactttctctgagttgggctctcttgtttgttgttgttgtttttgaaactgtctcactctgttgcccaggctggagtgcagtggcgtgatcatggctcactgtagcctcgacctctgagttgggatatcttgaaggaatacatgaaggaaaagggaacagagattaaggttttccaggctttgggttgtaatcagacagtttagctgtattctgaacacccagcacttaatgtgcttggttatccatgtgtatgtatcaagggtgggggaactcatggagtgagtcactgagtggtatggtttaaatggcaggaaactcttccctcaccccgccttgggtaagaaaagggcatagcagagcgctgacacacatccctctgctccagaaagtgtacagtacccctctgctccccactgaaaccctaaagttgttcatcttcatgtgtgccaggaaaggagtggatctgtgatgcaaataggattatttggtcatatctgctgactcagtctaaagaagcttttgaaggggatgagatgaaatttcatctatgctgcagagagcaggaggtgcattgctggatggagagaggactgtaggctgcatgtgagccaaggtagacgagggaagcatgggggtgggcatgaggaactggggcagcctgacacgtgatcttggcattgcaaaactgatatcctgttggcctttgggccacatgatatgatgacagtgcagtatccccatggccctttctttttctagatttcatttatgatactctcagatttttaaatagcatgactttccccagggagaaattcagacctcaggtctctaggactgctctgaggtcatgagatagactcagtttgaacctgttgagtttaaatgtcttggaatgattttagcatctcagtaccccctttcccagtgctcatctggtcagctgctctggaacctgagggattctaaactgagacttagtttggggtcatatgcagttaaaaagggacagtcttttggcaccttcacctcggaggtggctgctttttggcttagcgttggactcatcactgaaaaagatagttgagaggttgtttttgacctgagcagccttattaagactcagttattggcaaaggagagaaggctctgcttataaatgttgcagatttaaaggggaaagaggaaaccacagtaagtaaagagcgattcagggagaccagtttctcttttttattcagaatgctgctcaggtatctgctttcctaggagccaccttattgtcaggttctgccttcggtttatgtgtattcttcccttaattcttagaagagggaagatgctttggggttgttcacaggttcccattcgacataaaatagaagctgcctacctttacatatactcagttttatcttctccaagtctcccagaagttctctttgaaagttcctagagcagggactgcttttattttttttccttctcctaggctttaagcatgtatttagatgtatgtcaccattgggtaaaagaaaggctaaagattcagataacttttcccatctgtggaaacatggaaagcagtactcagcagaggaatgaggactgattattttgggcctctttttactttatccaagtgaagaatctactgtgctatatatttgtcaaaagcaattccaaagggcaggggttgggggaaagcagtacggcataataagatttgggcaagttagataggagctgtgcagttggtaatgaagaagcagaactgtttctttctcattataaaagtaatccatgctaattgtaaggaaaagaaataaaatattatagaaagcaataaagaatacaataataataactgataattcctgttaatatgttggtataatttcttcttagttttctgtaggtatagatttcggctcactgcaacctctgccacccaggttcaagcgattctcctgcctcagcttcccgagtagctgagattacaggcactgccaccacacccggctaatttttgtatttttagtagagacagggtttcaccatattggtcaggctggtcttgaactcctgacctcatgatccacccacctcagcctcccaaagtgctgggattacaggcgtgagccaccatttttagaaacaaaataaagatcattctacatatgatactttgtaatatttaaaatataacgggattgtttacccatctaattaagtattcttaacatgatttctgatggctacatagtattccattgtttggatgaacataatataatgtatttaaacactgttctgttcaattcagcatttgatttatcgggtagacatgttttgaagggatcttgaatagtacagtggaattagagttatagttgcggttctgcttaattcttagctctgtgatcctgagcatagattaaagtcttagcttccatttcctcatttgtaaaagaatgctattaatagtaatgaccctcctgagtaaaaatggttagatgacatgacccatgtaaatttcttagcatgaaatctaacatataccaggaactcaataattgttagtagtagcgtatagcattatccttgtcttgacactttgtcatctgtgtactcactgttagaatttgggtctcaaggaaagaaaattgctttcatttagataagtaaaatttcagaatgaaaattgcctttagataggtagcctcttttaccagttgagtaccttccagataggggcatttgccaacttcctgaatttcacagggaaaaaaaaaattctgcagtctctgtggttgtgcggccccatttggttcagaacaaggaagtgggaaaccaccagctgcaaccagggaattatctttgtgtccgcaggcaaagccagccaagcccccctgttctacttatctttttttttttctttacttgcttgttttttatgttcttttagtctgaatttttttttttttgagcagagtcttgctctgttgcccaggctagagtgtagtggcacaatctcggctcactgcaacctctacctcctgggttccagcgattctcctacctcggcctcctgagtagctgggacttcaggcacatgccaccacactcggctaattttttgtatttatttatttttttagtagaggtggggtttcaccatattaaccaggatggtcttgatctcctgactttgtgatccgcctgtctcagcctctcaaaatgctgggattacaggcgtgagccactgcacctggcctggaaatttttaaacatacggaaaagtgaatagcgcagtacatagaatacttgtatagcttctgcttagtctcagcagttgtcctactttctttatttttattttttattatactttaagttctagggtacatgtgcacaacatgcaggtttgttacatatgtatacatgtgccatgttggtgtgctgcacccattaacttgtcatttacattaggtatatctcctaatgctatccctcccccagccccccaccccatgacaggcccggcgtgtgatgttccccttcctgtgtccaagtgttctcattgttcaattcccacctatgaatgagaacatgcagtatttggttttctgtccttgcgatagtttgtggagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatacacccagtaatgggatgactggctcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcactgtggttttgatttgcatttctctgatggccagggatgatgagcattttttcatgtgtcttttggctacataaatgtcttcttttgggaagtgtctgttcatatcctttgcccactttttgatggggctgtttgattttttcttgtaaatttgtttaagttctttgtagattctgcatattagccctttgtcagatgggtagattgtaaaaattttctcccattgtgtaggttgcctgttcattctgatgttggtttcttttgctgtgcagaaactctttagtttaattagatcccatttgtcaattttgtcttttgttgccattgcttttggtgtttcagtcatgaagtctttgcccatgcctatgtcctgaatgctattgcctaggttttcttctagggtttttatggtttcaggtctaacatttaagtctttaatccatcttgaattaatttttgcataaggtgtaaggaagggatccaatttcagctttctacatatggttagccagttttcccagcaccatttattaaataggtaatcctttccccatttcttgtttttgtcaggtttgtcagagatcagatggttgtagatgtgtggtgctatttctgagggctctgttctgttccattggtccatatctctgttttggtaccagtaccatgctgttttggttactgcagccttgtagtatagtttgaagtcagatagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatatcgatacttcctatccatgagcatggaatgttcttccatttgtttgtatcctcttttatttcattgagcagtggtttgtagttctccttgaagaggtccttcacatcccttgtaaggtggattcgtaggtattttattctctttgaagcaattgtgaatgggagttcactcatgatttggctctctgtttgtctgttattggtgtataagaatgcttgtgatttttgcacattgattttgtatcctgagactttgctgaagttgcttgtcagcttaaagagatttggggctgagatgatggggttttctaaatatacaatcatgtcatctgcaaacagagacaatttgacttcctcttttcctaattgaataccctttatttctttctcttgcctgattgccctggccagagcttccaacactctgttgaatagtagtggtgagagagggcatccctgtcttgtgccagttttcaaagggaatgcttccagtttatgctcattcagtatgatattggctgtggatttctcataaatagctcttattattttgagatatgtcccatcaatacctagtttattgagaatttttagcatgaagggctgttgaattttgtcgaaggccttttctgcatctattgagataatcgtgtggtttttgtctttgattctgtttatatgacgggttatgtttattgatttgcatgtgttgaagcagccttgcatcccagggatgaagccaacttgatcgtgatggataagctttttgatgtgttgctggattcggtttgccagtattttattgaggatttttgcatcgatgttcatcagggatattggtctaaaattctctttttttgttgtgtctctgccaggctttggtatcaggatgatgctggcctcataaaataagttaggaaggattccctctttttctattgattggaatagcccctctttgtacctctggtagaattcggctgtgaattcatctggccctggactttttttgtttgataggctattaattattgcctcaatttcagagcctgttattgttatattcagggattcaacttcttcctggtttactcttgggagggtgtatgtgtccaggaatttatccatttcttctagattttctagtttatttgtgtagaggtctttatagtattctctgatagtttgtatttctgtggaatctgtggtgatatcccctttatcattttttattgtgtatatttgattcttctctcttttcttctttattaggcttgatagtggtctatcaattttgttgatcttttcagaaaaccagctcctggattcattgatttttttgaagggtgttttgtgtctgtatctccttcagttctcctctgatcttagttatttcttgccttccgctagcttttgaatgtgtttgctcttgcttctctagttcttttaactgtgattttaggtgtcaattttagatctttcctgctttctcttgtgggcatttagtgctataaattttcctctatactcagctttaaatgtgtcccagagattctggtatgttatgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgttcagaagaatgtatattctgttgatttggggtggagagttctgtagatgtctattaagtccacttggtgcagagctgagtttaattcctggatatccttaactttctgtctcattgatctgtctaatgttgacagtggggagttaaagtctcctattattattgtgtgggagtctaagtctctttgtaggtctctaaggacttgctttatgaatctgggtgctcctgtagtgggtgcatatatatttagaatggttagctcttcttgttgaattgatcccttttccattacttaatggccttctttgtctcttgatctttgttggtttaaagtctgttttatcagagagtaggattgcaacccctgcttttgttttctatttgcttggtagatcttcctccatccctttattttgatcctgtgtctgtctctgcacatgagatgggtctcctgaatacagcacactgatgggtcttgactctttatccaatttgccagtctgtgtcttttaattggagcatttggcccatttacatttaaggtcaatatggttatgtgtgaatttgatcctgtcattatgatgttagctggttattttgcttattagttgatgcagtttcttcctagcatcaaaggtctttacaatttggtatgtttttgcagtggctggtaccggttgtttctttccatgtttagtgtttctttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccattctcttctggcttgtagagtttctgccgcaagatctgctgttagtctgattggcttccctttgtgggtaacccgacctttctctctggctgcccttaacattttttccttcatttcaactttggtgaatctgacaattatgtgtcttggatttgctcttcttgaggagtatctttgcggtgttctctgtatttcctgaatttgaatgttggcctgccttgctaggttggggaagttctcctggataatatgctgcagagtgttttccaacttggctccattctccccatcactttcaggtacaccaatcagacgtagatttggtcttttcacatagtcccatatttcttggaggctttgttcgtttctttttattcttttttctctaaacttctcttctcattgcatttcattcatttggtctttaatcactgataccctttcttccacttgattgaatcagctactgaagcttgtgcatgtgtcacctagttctcatgtcatggttttcagctccatcaggttatttaaggtcttctctacactgtttattctagttagccattcgtctaatcttttttcaaggtttttagcttctttgcgatgggttcgaacatcctctttagcttggagaagtttgttattaccgatcgtctgaagccttctgctctaaacttatcaaagtcattctccatccagctttgttccattgctagcgaggagctatgttcctttggaggagaagaggcgctctgatgtttggaattttcagcttttctgctctggtttctccccatctttgtggttttatctacctttggtctttgatgatgatgacgtacagatggggttttggtgttgatgtcctttctgtttgtcagttttccttctaacagtcaggaccctcagctgcaggtctgttggagtttgctggacgtccactccagaacccgtttgcctgggtatcaccagcggaggctgcagaacagcaaatattgcagaacagcagatgttcctgcctgatccttcctctggaagcttcctctcagaggggcacccggccgaatgaggtgtcagttggcccctactgagaggtgccacccagttaggctactcgggggtcagggacccacttgaggaggcagtctgtccgttctcagatctcaaactccatgctgggagaaccactactctctttaaagctgtcagacagggacgtttaagtctgcagaagtttctgctgccttttgttcagctatgccctgtccccagaggtggagtctacagaggcaggcaggcctccttcagctgcagtgggctccacccagttcgagcttcctgcctgctttatttacctactcaagccttagcaatggcagatgccccttccccagccttgctgccgccttgcagttctatctcagactgctttgctagcagtgagcaaggctctgtgggcatgggaccctccgaggccaggtgcgagatataatctcctggtgcgccgtttgctaagaccattggaaaagcgcagtattagggtgggagtgtcccaattttccatgtactgtctgtcacggcttcccttggctaggaaagggaattccccgaccccttgttcttcccgggtgaggtgatgccctgccctgcttcggctcatgcttcatgggctgcacccactgtccaacaatccccagtgagatgaacctggtacctcagttggaaatgcagaaatcagtggtcttctgcgttactcatgctgggagctgtagatgggagctgttcctattcagccatcttggacgggcaagtgtcctactttcttatatgtgaattctgaaacgcaaggtcctaactgcactccctgccacaagacagacaggattgcgctacagcacctcacaaagtgggaaaaaaatgtatacactcttagatccaggggtttatagaaacagaaagtcagtgcagaaggactctggactccgggatggtagaaatagattttattttttcagatggagtctcactttgtgcccaggctggagagcagtggcatgatcttggctcacttcagcctccgcctcctgagtagctgggattacagacgcatgccaccatgaccagctaatttttgtatttttagtagagatgggatttcatcatgttggccaggctggtctcgaactcctgacctcaaatgatctgcctgccttggcctcccaaagtgctgagattacaggcatgagccactatgcccagccagatcttttgtttttataatacaaatcacagaaagtaaatcttagtgtctggctgaaggaaagaagtagatccagatgtccatcaacatgacaatgggtaactaccttgtggtatattcataaaagtgaataatattcagcagtgaaaaacagatgaagtagagctacatgtataaacatggataattagaagttaagtgaaaaatgtaatttgcctaataatctttctctatacaatgtaccatttatttaagggtataaacatgaaacaacactatatgtgatttgtagatacatacaaacataataaatgtataaaaacgtgggcaacaaggaagtcaactactttagagtagaggttccccttgtagatggttgggtgagatgaatcgtattcaggaagggtacatagaggacaactgaatcaataatattcaaatttattaaagctgtatggtaggtgcagaggtgctaatttttaaaatattttactgtatgtttaaaactttaagtgtaaagaaaaaactagggcagaaaaacgttgtttaaaatgctcagaatcctggatcacttattttgtgagtgtgaaagctgagactgggagagttcagtgttttgcttctcatatacatttttgaattttgttcaattatcatacagccaaattggcttttttgggaataaagttctatgaatcttaagacatgtatagattattataattactaccacagacagggtttagaactgctccatcacttctaaaaacttctcatactcttcctttagtgtgacacccagatttctaaaccctggcaaccactgaccagctctgcaatcactgtagttttgtcctttggagaatgtcatacaaatggaaccttacagtgtgtaacctttagagagtgggtttgtttacttagcataatgcctttgagattcatctgagttgatacatgtatcaattgtttattcctttttatttctgagtggttttccatggtctgtaggtaccacagtttgtttatccattcagccattgaagggtacctggactgcttccagattttgtctattatgaatagagttgctgtaaacattggtgtagagggttccatgtaaacataagttttcatcttagtagggagccaggagcagaattattgagttgtagggtgagtactagtgtttttaacttatgaaagttttttctttttctttttttattaaaaaaaacctttataagataccatcaaatagttttccaaatcagtgcttttacatttacattcctaccaacagtgtatgaaaattccggtttctgcacattgctattgtcttttttgttgttgttgttattatagcaattcagatgagaagtggcatcttattatcgttttagtttgcatttctctaatggtagggaacatttttatctgcttatttgccgtgaaaacaacaacatattcaataacaacttcttttggtgaagtgtctgttcacagttttttcagccctttttttttcttctttttttttttttgagagggagtctcactctgccacccaggcgtgatcttggctcactgcaggctccgcctcctgggttcacgccattctgctgtctcagcctttcacgtagctgggactacaaggcacccgccaccacacccggctaatttttttttttttttttttttgtatttttagtagagacggggtttcatcatgttagccaggatggtctcgatctcctgaccttgtgatctgcccaccttggcctcccaaagtgctgggattacaggcgtgagccaccgctcctggctgagttgtgtgttttcttattgttgaatttcaggattctttatatattctggataaaagttctttgttggatatgtgatttgcaaatattttatcccatgttatatgttatatagcttatcttttcattgtcttaaagtgtctttcacagatcaaaagtttttcattttgattaatgtcagtttatcattttttttttcttttatgtattgtgtttttggtgtcatgtctaagaactgtttgcttaactgaagatcacagattttttcatatatttccttctaagacttatagttttatattttctatttagatttatgacttagcttttatataagttgtgaggtttaggttaagtttgttattttacatatgaatgtccaattgcttcaaccgcatttacactattttcaaaaatcaaatgattatatttgtgtgggtcaaattctggactattatgtttcattgattgatgtgtctattcttgggcaatactgcattgtttcggttgctttaactttgtagtaagccttaaaatcaggcaatgtgactccttcattatctgcttcttttacagaattattttagctattcctgtttctttgaccttccatatacactttagagtcagtctatctataaaatatcctgttgggattttgatcagaattgctttgactctatagatcgttttggtgagaaatgacatctttcctatgttgagcctttcagtccttggacaaggtatgtctttccatttatttaggtcttttattttatcagcattttgccattctcagcatatggatcctttaaatattttgttagatttatacttaagcatttcagttttttgaaacattttaagtggttctttcaaaaatgttgcttttcaattgtacactgctactgtgtagaagtgattgatttttgtgtgttgacttcgcatcctgtgacctttaaaaactaatgtattttttaggagcttttttgtagattccttgggattttccatacatataatcacgtccattgcaaataaggacagttttacttcttccttttcgatctctattatttttgttgcctgatttcctcgctaaagttgccagtctaatagtagtggtgagagtggacatccttgtcctgtttctaatgttgtcggggggagcatttagtctttcaccattaagtattagattaggcatagtaattttaggtgccctttatcaggctgaggaagttccctacatcaggttgaggaagttccctactattcctagtttgatgataatttttatcatgaatagatactgaattttgacaaaataccctttctgtatcagttgatatgatcacgtactttttagtcttttttagtcttttcagcactgatttggtgaattatattaattgaatttcaaatattgaactaaccttgtgttaccaggagaaaacgcacttggtcatagagtattattctttcttgtttttgagatggagtctcgctctgttgcccaggctggagtgcagtggcacaatctcggctcactgcaagctctgcctcctgggttcacaccattcccctgcctcagcctccggagtagctgggactacaggcgcccaccacctcgcctggctaatttttgtattttttttttatttttatttttttagtagagacggggtttcaccttgttagccaggatggtctcgatctcctgacctcgtgatccgcccacctcagcctcccaaagtgttgggattacaggtgtgagccaccgtgcctggccaagtattattctttctatactgctactttagatttgctaatattttactgaggatttttgtgtctgttgttcatgaggaatattggtctgtctgtccttccttccttccttccttttcttcctgcttccttcttcttccctcatcttcttctttttcctctattttcttcttctcttcctctccttcctccccactacccaactcctctagttttggtatctgggtaatgtagtgatggaccattctgtttaattgattgatgtgttcattctttcccctcttcaactcaacatgagaaatgtttccttctcttttattttctgaacaagattgtataaatatttggtagaattggtcactgaaactgagtctggagatttcttattcagatgattttaactatgaattcaatttatttaatagtattattcaggttgtctttttcatcttgggtgagttttggagtttgtggtttttgaagaatatgtccatttcatctaagtggtcaaatttatgtgcatagagttggttggagtattcttttataattttaattgctagggttctaatatcttctttcattgctgatattgttaacttttttccttctctctttttatccatgtcattctacctagaagtttataaattgtattgacttttttcaaagacaaacttttggttttattgatttttttttttttttttgagacagtgtctcactctgtcgcccaagctgaagtgcagtggcatgctcatggctcactgcagcctcgacctcctgggctcaagtgattctcccacctcagccttccaagtagctgggactacatgtttgcaccactacatccagctaattttttaaattttttttgtagagacaaggtttcaccatgttgcccgggctggtcttgaactcctgggctcaggtgatctccccgccttggcctcccaaagtgctgggattacaggcgcgaggcactgagccctgcctctctattgtttttcttttccatttcattgatctctgctctttattatttcattttttctgcttgccttgggtttattttgctcttattttttttattcttaaggtggaagcttagattgctaatttgagaccattctttttgcctaatataagaatttccagctgggtgcagtggctcatgcctgtaatcctagcactttgggaggccgaggtgggtggattgcttgaggccaggagatcaagaccagcctggccaacatggtgaaaccccgtctctacaaaaaatacaaaaaaaaaaaaaaccaacacaccaaaaactgggcatagtggcaggcacctataatctcctacttgggaggctgaggcaggagaatcacttgaacctgggaggcggacgttgtagtgagcccacatccggccactgcactcccgtcctccagcctgggtgacagagtgagactgtgttaaaaaaatttttttcctgttactagcatatttttgttgttgttgttcagttcaaaatattttataatttcctttgagaattcctatctatgaatttgcctttccagccatccagagaatttgtcatctgttccatatctttttgttcttggttgttatcaagtactaaattaaaatagaattcatctcgtgaaggatcataatagcttcatttgttatgaataatgtgatattcatttacattgatctgttaaggataatacagccactgtatattgagtgcttattatattctaggcactacattgatcactttacatggtcttattttattaaattctctaaccctttcagtaggtactcttattagttcaattaacaattgtgaggcaattgacacatattttaagtgatttgtctgtagtcacttggccagtaaatggtagggatgggatggaatgtagacttgattccaaacccccttaaccattttactacatttcctctagttatttcacttcttgccttctcataaaaattgttagctttttgagggcagatactgtgtcctacttatacttatcttcttttccctacaatacctgcaacaatgttaggcacacagtaatggattgactaatgtttgtggaactaaattcaacaaaattaactgatctagaagagaatcaaaaccatggtgcttgccatattgcctcagattcttaccagctaagcagactcagtgtagcatcctatacaaaaccaaaaaagcttataggaaatatttgtgtcagtaataatggctatcttgtgttcttttgtgatgatcagtcagatgtggccacaagagtagacagaggagagggtaaggaaaaaacaaagtttattatattcactggtcccagagacaagaggctcaggatactaggcaaggccacttgggaaagacattagggtggtcaggaggcaggagataggagcaaggaggaagttttagtccactgcctttattggggtttccacagaaaaagcagggcagggcaggacagggtgaatagttaaggattggctagtttgaatagtttcagcaggcctctaagctgtagggctgcaccctagttgtctggtgtctggccctggggcaattaaggaagaggaatatagcctcctggggtataaggggcagatagaggaggtctggctttggattggttagtttgcatatcaaaggcatgtttctgggtgagtacttgctgtctctaagaattggctggaggatgggggtcggggtgggggcaggctgtctctagccagaaaggtttttaaagataccaaaatatcacaatatacagaaaataaaatatatgctgcatatcaagcaattcaactttttcttgtaatatcatgacttttctttgcttcttgggagcacttccagcatgactggtggcacttcatctggatcccctggtgttattcaggggttacagtatcacactaaacaggatggaaaacatgagggaagggtcgacccttgaacaacatgggtttgagctatgcaggtccacttagaagcagattttttcaataaatatattggaaaaaggtttgggggtttttgacaatttgaaaaaatttgcaggcaagtcttatagcctagaagtattgaaaaagattaagaaaaggttaagtatgtcatgaatgaataaatacatgtagacactagtgtattttatagtttactactctaaaatatacacaatctattacaaaaagttaaaatttatcaaagcttatgtacacaaacacttatagactgtacattgtgccatcgtaattgagagatgtaaagatataaagatgcactattaaaacataactgcataaaattagctgtagtacatactgtactcctgtaataattttatagctgcctcttgcagtgagctcaggtgttgtgagtatcccttagaatgccctgtgcccctgatcatctccgaatgggctgttctttctccagtaaatggttgatcccaataaaaaagtgatccttgtggttctcgcatttttcatggtgtttagtgcaataccataaatgttgaataacaccagaggacccatacaaagtgcactagtcatgctgaagtgctcccaagaatcagagaaaagttaagacattacaaggaaaagttgaattgcttgatatgcaccatagattgaggactgcagctgcagttacccactattttagacgacgattcatcttgtgaacagatgatgcaaacttatggtattgataaatgtagtacagtactctaaatgtattttctcttcctcatgactttcttaatattttctcttctctgtaagaatacaatatataatacatataacatacaaaatttgtgttaattgatctcagtaaggcttctggtcaacagtaagctattggtagttaactttagaggagttaaaagttataggcagattttagactgctcagggagtcagtgcccctaacctccacattgttcaaagatcagctgtatatacaatacaaagaccaatactctgagctggtaaggaggtttataagtatgactaaccaaatataagtctgccccaagctctgctttttggttctggccttcagtctgtccatctgctttctctggacctccttctcatactttgaattttttaagtagtttgtccctcatatgattttttttctattcctttttcccttcctgtccttccttcactcctttccctcccacctccctccctcccttcctctctcccttccttccttccttccatccaaccatccatccatccatccatccatccatccatccatccatccatctatccatcttgaggctttaggtgagttcttcaccatttatttaacaaatgttttatatgagtcttactatatgccatgcacattttaatgcattttttaaatataattcccataacaatcctatgaattgggtactattatggttcctattgtacagatgagggaactccctcacaggactttctagtggccctatagccatttgccacacccattacaaatttttgtggcaggctggaggggggtataaagttaaaacaaaggcctctgcttctgagttggtcagtcatttacctgtagagctgtgctttgtcggtaaagggcaatgtagttgtgtgatcaggatagttgccacagaacacacaaggggtttaggcatgaccttccttgccccattggcacgcaagaactttttccttcctggcctgcagtctgatacatacacacatagaaacacagacacacacacacacacacacacacacacacacacacacacagacacacacacagagagagagagagagaatgagagagagagagagagagagagagagagagagagagagagagaacatatgtaacattcatgccatggatttaaagcagagtacaatggcaaaaatacaatcttgaaacttggcgacatctgagcgtgacttcagcctctgccacttattgtctgtttgatcttgggcagatcacttaatcacttggagctttggttttctccactatgaaatgaggaagatgatggtggttataataaaaactctgatgactgaatgagatgatatatttgaatccttagcccagtgatttgcacatagaaatgttcaatacatgttagaaatgtttgtgattattaatatgcaaggcttctttatgtattaaagataattcaccctctagcatatatatagcttgtataaactgaattttgagaacccagagcaatgcttgtctttatctagggacttaactgttttggatcttgatgttagttttatcttcatctttggccgtccgtaggtcctgatcagttccatcaacctcaagatttaacttttggtgtccaaatgtctaattggccctgtgcaaatgctgacatttcttttgaggtccatggcaaagcctggcaccagaatccagcttttttttttttttttttgagatgcagtcttgctttgtcactcaggccggagtgcaatggcatgatcttggctcactgcaacctctgcctcccaggttcaagtgattctcctgcctcagcctcctgagtagctgggactacagacgcctgccaccatgcccagctaatttttgtatttttagtagagacggggtttcgccatgttggccaggctggtcttggactcctgacctcaagtgatcctcccgcctcagcctcccaaagtgctgggattacaggtgtgagtcaccacgcccagcccagaatccagctttcatctggactgttgatgtgatttttttttccctctcccagagtgagtctttatgttgtggctgtcacataggagggcccaggggcagggttaagccagattctacttcactgaaggcctggaatggctgttaatagctcctgctatagacagtgaggcttgagccagattttttagtactccatttgtcagacacggggtgccaccttgaatgacactgctgaaaaaggattgtggtaacctggccagccccagggaggttggagtgacattgcgttggtgtgcctcttcccttttatggaccaggccaagccctattaacctgaaggagtgtgatggccttgtttagccaaacagccttttccactttagtcatcctttgaaatcttattaagccaggggcagggaaggaagaaggaggcagacagactcttgaaactaaaaggagggaaagaggaacattctaaccttccacctgaggtcatactttggcaggaggaagggaccagggaattttatacaaggcagcaagagagatataagagtttggggtctggagtcagataaacctggttttgaattctgactctactctcttatgtgtggtgttgaccagatcacctcacttctctgaaactcgtttccttatcaacaaaatgggaaaagtaattgtacctatctcagaagattggtataaaaattaagcaagaaagttcatgtaaagcagttaatcagatacttgcctggaatattattatttttcttctggttcttgattaaggatgcctggaatatattaagtgcataccatcgctattcgcaaagttttggtgacaaagaacaataggaagaaacagcctaggggaagtgaaaagcagtcttggggtttctgtgccattctccggggtctccttgtaacatctttcagtctgtctcccttcccttcttccctttttcccttcttccctcccctcccctcccctcccttcccctccccaagtcttgctctgtcgcccaggctgtagtacagtagcatgatctcggttcactgcaacctccgcctcctgagttcaagcgattcttgtgcctcagcctcccgagtagccgaggttacaggcgcctgccaccatgcctggctaatttttgtatttttagtagagacggggttttgccatattgtctagggtggtcttgaactcccgacctcaggtgatctgccagcctctgcctcccaaagtgctgggattataggcatgagccaccgcacccagccacatctcttagcgttacaaacacatctgtgagtgccaagagaagaggtaaagttctagagagtcttcaacatgtggactgttttcccagccagggcataggaggtatgctgtgtgtgtgtgtgtgtgtgtgtgtgtgtgtgtgtgtgtgtgtgtgtgtgtgtgtgtgattgagattgacatcaacccccatctagtgttgaggtctaagaggcgtgttgcctcggtggtggttgtccatgacccatcaaatcaacgtttcttcaagaggaacagactgtcattcttttcatctctcttagtagtaaagaaccatttgcctttaataatgaaggaagctacttaaatccatccccagagccctcacaagcagggtttgttcctgagttaattgtgcttgacttatgaagggtttctaatgagtatgtattttaacaagtctggcattgggattgggaaacagtatcattaaccagtgctggagaccagtggttttcttcttcttttttctttttgttttgcttttaagtcacagagcccaatatgtaaatgaaagcctggaaggctgcccacttttgctcctgagggcatttctaagaaagtggggaaatatagtttgcaaaacactgcagttggcttcctgggttgtagcaatctttttctgtttaggtctctgtttggggaaaaggattatacatgacagtgtaaataagcagccatgttataataaataggtttctactgtaataacagaacacttacctcccgcagttccccttttctaatgccgcccaagctgtagcagttgaagccgttgattgggactgactgaatgtttagggaacacagagctcattatttaataaagtgttgtaaccaaagtatgttcaggaagtgttcaggggattctgagccagtgatggtgctcttcagaacatttcagttaatacaaaatatgccactattaattcattttgtgcaaactccagtgccattttccacagagagcaacttgtatacatagttctcttccatatgccgtggcttaacctgatgtgtcttttttctccctttgtatcagggtctgagtatgacctgaactttatctttctccccctctaggctacagatgcacatgttgaatggagctcttctggcattgctgtttcctgtggtaaacactcggctggtaagtagcctcttctaggaatgtaacagcaacatgcaaagcagtacttgcctatatgcccatgtgattttaaaaatatacatatagctggccaggcgcggtggctcacacctgtaatcccagcactttgggaggccaaggcgggtggatcacttgaggtcaggagtttgagaccagtctggccgacatggtgaagccctatctctactaataatacaaaaattagccaagcatggtggtatttgcctgcaatcccagctactcgggaggctaaggcagaagaatcgcttgaacctgggtggcagaggttgcagtgagtcaacattgtgccactgcactccagcctgggcgacagagcgagactcggtctcaaaacaataaaaaaataaaataaccagggcagaccaaagcctatacaaactcttggagaggtttaatggaaagaaagcagctttcaggtgttctaaggggctctcgttagattcaaccacattggccttgaataatttgctgtgggagcctcataacctgtccacttctccaaggacttcctagggcaagaattagattccttccccatccacccaaacccatgggccagtctggaccaaacagcccctcatggctagcagggagaatcccatggttgcagcgggctgggtgataaaccagcccagaaagaagcaggagctacgagccatgtcctcagactcccaaatgtgagactgtggaggcattagcaggtcacattgagaagctcagaaaaagaaatcacttataaaattattactactgctttctgacttaaatttgccttaaacattaagatcatagtttaaatctttaattgataatcatttttggatagcattttacagtgtacaaggtttttcgcataacagtgtttgaggtagacagggcaagaattatggcctcttgttttacagaggaagaaaattttactcagggagtaaaattccaagtggcagttaggattggagcctaagcctcttgatcctaagatcacagctatgctttgctccctctccacaaatattcctgtcatctcctccccacaaatattcatgtatacctttatgatagttacaattttcaagatgcatgtcatatatcagtagaaattatagagaaaacattcatctaaagcagcgattttgaaccctagtatgttccaggctcacctaattagcttgatttaatcatttcacaatgcaaacatacatcaaaacatcatactgtacgtaccttataagtacccacaattatttgtcagttaaaaataaaattaaaaacaaacactgatgcgctgccccacccttggagaggatgagttcatgatctgtgataaagcctgagcattgtgttttaaaaagttccccaggtgattctagcatggagtgggagttgagaaccactgatttcatgcaatgattctgaaacgtaatgttcatagcaatcaactgaagggcttgttaaacatgaggcttgtcaggccccatccccagagggtctgattgagagagtctacaagtaatggcagggactgaatgtttgtaacaagtccccaagtgatgccaatgcaggggtccttagaccattcttggagaatcactgtcccaggtgttcgtaactcacagttactccaagtgtgtaactcaaagtgtggtcctaggatcagcatcacatgggtgttgcttgttagacatgcagaatttcaggggccacctgcagaccacctgcatcagaatgtgcattttaacaggactcccaaggtagcttatatggactagaccttttctgccaaggaccccaaagcatcttacagataaagcatttgagctctcgatggaggggaacatctgtgttggggagggcagggggcacagcctctgtcttaatagtcagggtgcacttggttcaacattcccctgtgagctgggatcagtaggcacaggccgctgacacaggcactgttgccctgccttctacatctcccacagtctgtgacttgcctgacttcacctggtggactgtagaatcagaactcctgacttggtctcagagttagatggggtaattccaaagaatggtaaaaataaaccaaattgggaaacttaacaaaaaacggtgaatttcccataccacagcataagtccttcctgcctcagggttgtggaacagggttggagcagaagttacttcctgcttgtggaggtaacctgctagggcagaaaagtagatccaatgctatcttatcatctctctgctcccccttgtacctgttttctcaggagactgagaagtcaggcagatagagagctgctttctcaaatttcagcagctctatcagatcccagaaaaggaaggtgcatcagaaaatctccccctaggctaatagagttagtgatcctgaattggggtgtttccagcccacaactctggccaaacagcacctgctgaggtggatagatatagttcctctagacaggccaccttcagctctctttctagtaggacctttcccccagtgaaaaccaaatatccttcttcttgcaaagccattgaacataaacagaaattttgattctcattgtagaagcatgagaatgaaggccccaaaatgctccattacatacctgaaatcagttagaaagctggtggtgaagttttcattcagtcaatattgttacacaaaaggtacatatctccctgggtctgctgaagtatccttagtccctttatcaataacagtagcggttgctgggtgcagtggctcacacctgtggtcccagctactcaggaggctgaggtgggagtatcacttgaggccaggagtttgagaccaacctgagcaacacagtgagaactcatttctaataaaaaatttaaaaatcagctgagcctggtggctcacacctgtaatcccagcactttgggaggtggaggcaagcagatcatgaggtcaggagattgagggcagcatgatgaaaccccgtgtgtactaaaaatacaaaaattagctgggcgtggtggcatatgcctgtaatcccagctacttgggaggctgaggcaggagaatcacttgaacccaggaggtggagattgcagtgagccgagatcacgccactgcactccagcatggcaacaaagtgagactccgcctccaaataaataaacaaataaatagaaattaactgggcatggtggtgcaagcctgtagtccaggctgcttgagacttccgccctcccttctgaggtgggaggattgctttatcctaggagttcaaggctgtagtgatttatgatcatgccattgcacaccagcctaggcaacagagtgagactccatctctaaaaaaataaaaagtaacagtagcagcactatcagctgctgattcttgagtgcttactatgtgccactgttctaagtgctttacatggcttagatttatttaatcgttgcaataaacttatgaggcaaggtactgttattcccaagatcacagtgcgccagcaaggttagtttcttctgaggcctctctttggtttgcagatggccaccctcatgctgcctcttcacttggtcctttctctacacacacatccctagtgtctcttgtttagccaaatttcctcttataaggacacacatctgattgcatagagcccactgtaatggcctcctttgaacctaatcacctctttgaaggccctttctgcagatactgtacagtcacattctgaagtactgagagttagggctccaacatatgaattttggggggacacaattcagctcatagcacccatactaccctacatagaaaccattgtttcttcccctcaccctgctttccttcctccctccctcccctctgcctttccttcctccttccttttccgccatctcatagcagatgtgctggtgtatctgttacattaacagctaatactttccaaataaatgtgaggctgtagtcaactaacttatcaaaaatgtttaagtaacctctcctgacattgaaacttctttgttgggctgtctcttaactagtgattccagccaatctggtcaatctttgtgctctttttctaaagtgatgcttagaaaagctgggaatgtctccatttgcctatgtatttgcaattggtttaggtctggttcttttagatggttgggatccctcttggactactctggctttagggctttttgccttgcagccccttagttgagctcagattgacttaacatgagacacatgaggattggcaactctttcttaaacctgatgatccaattaggttgtaagccagcttttgacttttgcccttccttcttggccctttatctttttaattattttatttttttgctcattagcagtaatgaggaagcaagaaaaataaaatgaactgattagtgtgtgtactggtaccatagacatacatatactcacatacacaaagacagagtgacagggcattggaagtagttgtgacagtcagctaaaggatttggggccctcagtgaatttccatgtgttctactctgccctgtgacttactggcaccaggatttgcaaatcagctagagaatgcctaggcttcagtttctctgggttctccatctttaaagctgaaccctaaaagaaggactgtgtattccagtggcccatattacaagtaagtgctctttacacctaggatcctggaaaaaggtctttttctagattcagatgaattatattaaagggcaatttccagtgatatgcccttttgtttcttggagtgaaggaggggaagtacatgatgaacctattgattattagattagcagggagctcaaagcttgtctgatgtcatcttatcttccagagggtaaatttaggaggataaatgacgagtttcagtagtcaaggtgggtgtccccagaacccatatctcttgactgagacttcagaattatttttctattccatgaatgaaattcagggagagtttgtgtgctggtgatagagtctcttccttgataaatgcacaaacacacaattttgcagacaatttcaggagggacacagactacaacttcctctcctagcccctctcccctctgtaagcccacctattcatcccatgttaatgtcttcctgcctaggctacaaatagttcatagtttagggaatagatgtgctgtctagtgtgtgagttccttgttatagccgctggccatttgtcctgatggtgatactgggttccttatctatacccgtgactttgcaaagaatatcatccaatccaggataaaccactttcaggaaattaaagccaaggagtggaagctaagtagggtgtccatggaacctggttacagattagattttcagttacagtactcacgtgcaaagctagtgatctggccctgaaatgagacactgggcccatgctgcaacttcagcgctctgcttttcaccctctaacccccatgagagtttcttctgaatgcagaatgttgttagcaagggagactggatacagaaaagaaagtgaagatactatatcagccctcttcccagaccaaaaactctagcctggcctgcatttgtgtttgtacccatctgtcttctactaggagaagcatgataattattcttttcatcaagctcctttcttcttcaaggcctaaagcctcaagtacattattatcttattatcaaacttgcccattattatatatccatgttgatctattatgttagttcctttttaccccctttactaccactctccttttgcccagttctttctgctctgttggatgggatggttcttttgagtattcctaactttcagactgagtggaagaagatagtaatgattctgtcattactggggtgtctagcctccattcacaaacactatattgatgttcttgggatgcagcttttccactgacacaccttgtacccatgtgtgctgctggaaaaaccttgttgtcaccaatgcagataggcttgaaaatctcactctttgctaattggcacatcgaaatgtgctagttgacctagaaaagttatttctgtgactggcaaattgggctattttaaaaagttatagtttggattttggacctgaactgaggacagaatgtccctttattatcctgagggttcttaaagcgtacaaagcttggtttcaaaagaggtattaattttctaaagaattgagtgaggcacaatagtgcctcaaccttctgcaaaggccagtatgtttctgatcagatgaatgcattgtgtctgaggatgtggggggtattgagatgagtttgggattcctggtccaaaccaaattctagggactatcctagaatatgtcaacttagtagctttattttaagactaagctttgagggtcttaaatccttgatgaatccagcctagatcacaccagtcaaaccacagatttttattgagcactttcctgtgttaagtatcatgccatgtgctgcagaagatacaaaaacaaccagtgtacattcctggtcctcaaagaacttgcagtttagttagaaagataaagtataaatgcctgaaaagttatggcaatattaaagttgaaaacatgaaaaaggaaaaatcatggttgggcatggtggctcatacctgtaatcccaacattttgggaggtcaaggcaggaggattgcttgagcccaggagtttgagaccagcctgagcaacatataagaccctgtctttacaaaaaataaaaaaatagctgggcgtggtggcacatgtttataatccaagctacttgagactcaaggctgaggtgggaagatggcttgagcccaggaggtcgaggcggtggtgagctatggccaacactactgcacttcagtctgggtgacagagcaagaccctgtcacaaataaaaaagtaaaacttacaaggcattcaggcttgactgctaaattgcagttgctctatgtttcaagaaatgggaaaaagattaatattagcattcactgagcccatactattttccaggtaatttacacatatattattcaattctcataagaaacccattttacatatgaggaaactgaggttcagatcagattaaacgacttgctcagagttacatcatttgtaagtgctaaagctaaacctgtgcactttgtaccttaatacacagcctcctggagtaagtggtctggaaaggcttcatgaagaaataaagcctgagccaagccttgagggatggttagaatgtgcatgcaaattgcataggaaggaggctgttcaagctaagggaacacatggacatggaggcagaaaatagtcaactaagtattgagattctgaagagcagggtgggagtcagggattccagttgtacacagagacattaccacttatttgcaaatcacaagaagacactgtttctgtcatgtctcttaacccttacagtatttagattttgtgtacatttcctatcttttcaacctccacaaataagaatttcttatgtgtggatgggactttggaatcagaatagctcttttacacatatctcaccctagtgtagttgttaaggggattggctcagggatcagattctctaggttcatgttctggctgggccactcccttgtgtgtgtgtgtgtgtgtgtgtgtgtgtgcgcgtgtgcgtgtgtgtgtgtgtggtgtgtgtgtgtgtgtgtgtgtgtgaaggggggcaggggtgggagacagagaaaacacaaggagaacaaacttgtgcaagttacttatcctctgtggacctcagttctctcatctataaaatgggggtgataatagtgcctatttcataaagctattgtgaggattaagttagttgatgtgtgtaaagcaaatagcattgcactgttagccattattagtctttgatcctcaccaaaaccctgtgaagtgtgtattagcatgtccattttacagacagagccttagaaagtttaagtaacttgtacaggggggcacacaggaagtgacagaactagcatgaaaactttggtctttctgataccaaaggtcatcataccaaaggaaggtttggtcttcttctctcctagttatttagattgatttttaagtattcagccatatgaccgccttttggcaaattttatacagtatcgattagcaatttgggggcttaattttacttttaggatttttttgttacagaaatagtagatgctcatgactacagtagcaataatatattgtatatttcaaagtagctagaagagaggacttgaaatgtttctaacacatagaaatgataaatactcaagggcatggataccccaaataccctgacttgatcattgcacattctatgcatgcaaaaaatactcatgtgcactccataaatctgtaaaatattatgtatcaataaaaggaaaaagatttttttaaaaatgagatatgtgaaatatagtgaattatttcagataagttctaggaagaaaaataatacatggtcattgaaaagtaactcagaggactataaagaaaaagctaatcattttaccagcttttagtcctgttgcctcaagggtaaattgtgttaaaagtatctttttacacttatcctttgcttgtacatggagattaaagattttcatatttctaggattgttggtttatttgggttccagcttcttacacacttggaattctacaaataccactccagtatatttctttctcttttttttgaagtctcagtctgccacccaggctggagtgcagtggtgtgattttggctcactgcaacctttgcctctcaggttcaagtgattctcctgcctcagcctcccaagtagctggggtcacaggcatgcgccaccacgcccggctaatttttgtatttttagcagaggcggggtctcaccatgttggccaagctggtcttgaattcctgacctcaaatgatccacctgccttggcctcccaaagtgctgtgattacaggcgtaagccaccatgcctggcccagtatatttctttgtttaacttaaacactagataatcagtaatctcttcaggcatggacataactcttttcatccatagtttggttggactatatattcatatattccttctattctctgtgggtaaggacagtgtcttttttctttcaagtgagcagtttaataggataaaaatattgcggaccactgacctacttcaaacccctcatgttacacaaaaaatagacacagagagatttgttccagggtccactgttagataatggtaagctgaagtacagacttagaattcccgtttgtttacttcaaatccaggactcttttctgctttgccattctcattattcccgagttctgaagaccatagtttccacagagtgcatgtgcaagtggattatcgctggacaccaaattccaaatgttcaagtacacatcatttcagtacacacacatgtggctagtgtcctttccaacctttgccaaagtaccacctcactttatgaggcaaaatgtgtaatggagtcaaagtccgaagaaccaagcagtagattgtagagcatggatagagatcaataataaatacttcaaagttcaaaaatggcgacatttgattcattgtgaattgacttgtagaaagccccattggagctgaggacaagtgtcttttgttttgtggctgcccctacatagccttgtacttagcacctggtagatatctatagatagaataaatgaattcatcagccaacctgaacctctatgttgcttagggaaattctggggatccctctcacatatgtcctgggatcttgggtgcaaagacagaggggtgatagataatatttttttccaggagaatttttttttcaaccacctaaaataatgccattttcttgattacaacaaaagacatatttactgttgaaaatttgtgaaatatagaaaagtataaattttaaaaaaatcatcaccaatgcaaaggtgattatttttctggacactgaaaaaaaaggtggcggctttgtgccttttgtctttatacatttatgtatcatttctttacagaagtgatatatgttcaaaacagaaaaaaatggaggccaggtgcagtggctcccacctgtaatcccagcactttgggagggcaaggcaggaggatcacttaagcacaggagtttgacacaagcctgggcaacatagcgagaccccatttcttaaagaaagtaaggaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttaggtttgtcagtaggcccaagcccttcagcccatttagggagtggcagcagtgagtgccaggcagcagcctgtttgcctccagagcttactagtttgccttggcccttgtttgccttggccctgtcttcctaaaatcacattagaaggaacagcgtctggcagtcttacccaatgtcttctgtctccaccttgagccactacttcaagcagtgtttctttatgcaatagaagccttatctagtgagtgcttccactccttagtctgtggatcagtggttctcaacgctggctgcacaattagtatccccagagccactttcaatacacactcatttaaaaattttacatcattttatttttggcacctaataattgcacatattttggaggtacattgtgatatttagatacagacagtgtgcgaagatcaaatcaatcttgttagcatatctgtcacctcaagcatttatcatttctttgtgttgggaacattcaaatcctctcttctagctattggaaaatatacaatacattattgttaactatagccaccctacatggctataggacattataacttattccttcgatctagctataattttgtatctgttaaccaacctccctatctccaccctccccagcctctagtaaccaccattctactttccctttctatgacattaactttgttagctcccacatataagtgagaacatgtggtagttatctttctgcacatactcattttttaaaagcactccaggcaattccaatgtgtgcaaccagggcagctctgctgtacaccttgttctagttctgccctgccactggctggggcttggggctttgaaggatttaatttcaccatattaagtatcagtttccacatttttcaaatgggatttgtaaaatttaccctctctacctttcagacaagttataaagaaaagataccaaaagataacaatgaaaagataacaaagagctttggaaagttaaaagcactacacaaatgagcacttgccttgttctctctttgacttcagtcacaattttttgtaaagggggtttaattgacatataatttacaaatgaaaagtttatccttttcaaatatacaattcagtggtttttaatatattcacagagttgttcaattagcaccacagtctaattttagaacactttcatcaccccgaaaagaaattgcataaacattagcatcatccccattccttctttccttgttctggacccaggaaaccactaatctactttctgtctgtatggatttgcctattctggacatttcatgtaaatgtaaccatataatatggcattttgtgactgacttctttcactcagcagaatgttttcagggttcatccatgttgttgcatgtatcagtacttcattcctttttacggctgaataatattcctttgtattatatatcacattttgtttagccatttgtcggttagtgtacatttgggttggttctaccttttggctattgttaatatgctgctatgaacatttgtataaagctatctgtttgtctgctttggagtatgtacctagaagtagaattgctgggtcaaatgataactcagtgtttaaactttagagtaactgccagactattttccaaagtggctataccattttatatgtccaccagcaatgtatgagcattccaagttctcaacatcctcactaccacttgttattgtgtcttttttattatagccattctagagggtgtgatgtcgtagaggttgagtatccgttatccaaaatgcttagaactcgaagtgtttcagattttggaatgctgcactttgtacttaccagttgagcatccctagtctgaaaatctgaagtgcttgaatgagcattcttttgagcatctctttaatactcaaatttgacccagccatcccgttactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagtaaactatcgcaagaacaaaaaaccaaacaccgcatattctcactcataggtgggaattgaacaatgagaacacatggacacaggaaggggaacatcacactctggggactgttgtggggttgggggaggggggagggatagctttaggagatatacctaatgctaaatgacgagttaatgggtgcagcacaccagcatggcacatgtatacatatgtaacctgcacattgtgcacatgtaccctaaaacttaaagtataataataataaaataaaataaaataaaaaaataaaatatctgataaaaaaagtttcatattcaggaacatttcagatttcggatttttgaatgctatttctctgataactaatgatgttgaacactttttcatgtacttactagctatttgtatgtctttttggagaaatatcttttcagatcctttcccaaattttaattgggttgttttcattgttcagttataattgttctttctggatattaaacccttatctgatatataatttgaagcattttctcccattctgtgggttgtcattgcatttgcttgattgtatcctttgaggcacaaaatattttaattttgataaagtctaatttctctatttttgatttggctgcttgtgcttttggtatcacatctaagaaactgttgtctagtccaagatcatgaagatatatgactgttttcttctaagagtttcatagtgttggctcttacatttaggtctatgatccattttgagttaatctttatgtgtagtgtgaggaaggggtccaaattcatttttttcatgtggatatccagttgtcccagcaccatttgttgaaaagactcttctatccatccccattgaaatatcttggtatcctttctaaaaatcaatgaaaaataaatgtgaaggtttatttttagaccctcagttctatctcatttctctatatgtctatccatatgccagcaccacactgtcttgattgctgtagctttgtagaaagctttgaaactgagtgtgcattgtaacaagatcttctggggattagtgtgtgtgtgtgtgaatgttgaaaagggctggaaagcaaagttgaaagaaagcaaaatgagcaatatagtgttcagatgataaggcccagggggattgactagcctgaggccacatagccagtgattggcagatcttggttcagcactcaggtcttctgacttccacatcagtgctctttccacctcccctgttgcataagtactgaatgagatgcctttggttaatggacactctgagcaagagacttcagggttatttaagcaactgaactttgctcaatcgcctcatctgtacaacagaaatattacctctatcactggctgggcctggtggctcacgcctataactgcaacactttgggaggctcaggaggaaggatcacttgagccgaagtgttgagaccagcctgggcaacaaagtgagaccctgtctgtacaaaaaataaaataattagccagccatggtggcatgtgcctgtagtcccagctagtcagaaggccgatgtgggagggtcacttgagcccaggaatttgagaccagactggccaacatagtgagaccggtctctaccaaaattttttttaaaaaattagccaggcgtggcggtatgtgtctgtagtctcacctacttgggaggctgaggcaggaggatcacttgagcctaacagttcaaggttaccatgagccatgatcatgccatacactccagcgtgggtgacagagtgagaacctgtaataacaaatggaaggaaggaaggaaggaaggaaggaaggaaggaaggaaggaaggaaggaaggaaggcaggaaggcaggcaggcaggcaggcaggcaggaaggcaggaaggcaggctggctggacggaaagagggaagcagggagggagggagaaaggtacatcatagttattatgaggattcaatgaaataatcctttgttgggtgccaactggcaagatgaattcagttttccattgcataaaaagaatcggggggtaggcagagctcctcctgaggcccatctcttacctcaacaggtggcctgccaacctccccttaggtcccacacgcctaggaccttgagtggagtgaactgagactttagggcaaactgagggtttctttagaaagtccaaggaaagagtgatcacttctgggtcccggtactgcatgggtgccagttgaggaagctttggtggtaggatccggccagaggagctaacgcaggaaaggagtttggggtggaaaaacttcgtaagctaggaggtcctatgatgtagtggataagaacaggagtgtatgtatataattttatattgtagaaaattgaaagcatacacaaaagtagaaaaaatgttccctaatgcatctgtcacccagtttcaatgattgtcaccacatagcccatctttttctttttaacaatacacctcactccaccacaaatccattccacccccaacacaaacacctatccctggattatttggaagaaaatctcatgtaattttaactgtaagtatttcattatgcatgtctgaaatgtaaggacacagtaaaaaataaacattacaataccattatcatacctataataactagcaataattccttaaaatcatcaaagatacctagtcagcagagcccaggcttttaatctagccaaatcactgttccagtcttccttctacagcatcaatagcctgtctcagagcctgttttacattgtaaaatgaggacggtcataacaattcctgaatctttaataaggtaatgcatgtaaagtgcttaccacaatgcctgatacaaagtagtaaatgctcaataaaggttagctaagattatttattaataataataggaaatatttgagttgctattaaggtgcttttgagaatggctttgacttagaatcaagaggcagatttggagcccagcgaaatgattgttgcggggaggaataacgacaaaaacaaaacaaaaaaactttcaaagtggctgaaaagagagcaccggtatgaactgggaagtggagctgcagatgatggcgtcctggtaattttcctccactgtatgtagttttttccccctgcagttcccctggaggagagaggagaactggctcgggtgggggttgcaaatactagaaagtattctgggcaagaaggggcactgcaatcaaagggctgggggcccccagagtcctggctcaggagatgaagtctcaggttccctgggctcatgggcctaaagccccaccttgtggggaatggtctgagtgactctgtttctgtgcacggagtttggaggcatgaggcaggctcactacatcgtgttagaaacattcccattgttcaggaatggtcttgctctctgctgccagttccaggcatcagctgaaagctttttaataaaaatggaactcaaaggagacgtgataaggtacctgattttaacctgaagtgagagaacaccagatgtttcattctgtctgagggtttgagaggcaaagcaattagcagctgctactgatttagcaacagacacctgctaaatgaaaatctgtaaaaccggccaggcttggcagcagaagcgcatacactgcttctcaggcatttctgggaattgtaaattatgttggctcaaatggcagggcggggggcttccagtgaagctgaacatgctcatctagaccaggagtgtgtttttctaagatggcaataacttagaaatggctatttggttggtggatggagaggacgagatgagaacgaatcttccagaagctgcctggttcgtctctgctgctggcccagctcacaggtgccctctgggagtcatcctatagctgccctctggggacagatagggctgacagaaggacgagggaatcctgccacccctctcctcctgatccagagcacatctctccctgccaccaaaggcagtaagtctcaaagcaggaggaacacccacctctggactcacagcatctcctgctctgggacagttacagactgttggctttagcagtgatttggagagtttgtgcttgctttggctgggaaagagacttatccatagcctactgcctttcaggattcttttctaaggggatatcaatgcctgctctccacgtctattttctcgaggcccacagtggagcacaaacaatggaaacataggaatccatgcagagggctttagcgatctcctgggacactgcttctgtcctgtcttttagcccttatagtttatagtttagattttacatgtgtttcctatcttttcaaccttttctaataagaattccttacatgtggatgggacttggcaaccagcaaatctcaccttagtgtagttgttgaggatgggttcagggattttctagaaaataaatctattttctaggtttatttcctggctgggccactcctgtgtgtgtgtgtgtgtgtgtgtgtgtgtgtgtgtgtgtgtgtgtgtgtgtgtggtgttggtgggaagaacataaggttcttcatggagtgggtgttcaatatatgactgattgaagagaaggtcaatttgtaggtcaactaggtggtgctgaaagaattgagcaactcccatttgtgccttatgccacatgcactgtacataactgtgtcttggtctccaaactaggccagaggtcaactgtaacttgggccaaaggtgccttctgtttccagttttgagcaagggaatggcagctctccatatggagcagggaccagggggtgctgttggcagatgcatggtgagagctgtcctgaggaagtaccatccagagtctcgtcctagcaaggtgttttagtgtggttaaagggtcactcctggccgggtgtggtggctcatgcctgtaatcccagcactttgagaggctgaggcgggcagatcacctgaggttggcagttcgagaccagcctgaccaacatggagaaaccccgtctgtactaaaaatacaaaaattagccgagtatggtggctcatgcctgtaatcccagctactcgggaggctgaggcaggagaatctcttgaacctgggaggcggaggttgtggtgagccaagatcgcaccattgcactccagcctgggcaacaagagcaaaactccgtctcaaacaaaacaaaacaaaacaaaacaaaacaaccacaactcaactcctgcttccaaagatggaagtgagagaagattctttttcctttaactgagtgggcccttagttgagatatacagacatgttttaatttcactaactcggccccacagtgtaggagggggaaaggaacagcaagtagtccaggtagaggaagagctagggtccccacactctagccagaattgggggagctccaccttctctgatcaggggagagacaggattcccatcacctccttccaataactaaaataaccacagcacaaatatgtgtcctgtatcagcaagctgccattgaaagagggccatggaccctgcgtatgatagagcatgctaggtgcactcatggtccttataaaagcagccaggtatgcatgggctgggccctgcatgcacaagttacccattggtccactaaacgtatgttcctaaaacccattatggtcttaagaattcagactggcatggatgcaaaaattcagataacccctaagtaataaaagtacttatttttctttagaacctaagacctataagtctcaactaatttgaagaatactctggtgaccaaagggagaatgcctcttcaaaagattgcttttatttggaggttgcaggccttgcatagggtcgttcccccagcccccggggactctgttaatgaaggggtttgggtagggcttgagcctctgctccttcaacatttcagcatacacacaaaagagcctacttctcagcacagatgtgactactatgtgtccacttggatgtcacatttcagggaaggttcattcataatacaggtaaaatgttactatattttatcctctgttgttgctttgaaaagtcagtggtcagcctttttactcctttgaaagtaatcttttcaggtcacttttgaggtttttttgtttctttttgtttggtgttctgcaattttgctatatgtttcagtattgatttgttctttcttattctgtttgggagcctttgggcttctggtgtgtgggtatatatcattcatcaggtttcagaacattctcagctgttataacttcaaactctgcctctgttccattctattcttctgggaccacattttagagatatgttagtccatcttactgtgtcttcttatctcttaatctttctttgatattttctaatttgtcttactgtattgcactttggctaatttcttcagctgtatattccagtttattatttatctctttagttagttctatccattgagtttttatttcagttattatatttttaatttttttcaaacatacaaaacagtctgtaggtaataattttattatctgcagtctttaaatttctgttttcaggattcctggcttgtttccttgtgtatttaagttttctttattttaaatattattatttttgttgctttactgtaagttgcttattttccttgggattttatttatgggtagtttttgactcctggtttcctgtagaaaggatctgtcttcattcttgctaggcacctgagagctgccagtctggaatcatgctaaatgaattctgacctcaggttttttgattacccaagtagtatacattcacttttcaaatacacatgatggctggcttgccgttccaagtttttattggagataacctagttcctttccctgctactccaactcagtgtaaagattgagagtagattttccttatcgtcctagggggcaggagtaatttgtatttctagtacacgtttacactgaagtgtagctttttggggtcccagctttatgagagttatctcctatcagactctttttgggatatcttgacctttgtcccccatcccttatgccctgtgaagctatgagaaatcaaagctcaagttcagctggcttagcaaatctactttgggtgaaaattggatgccgtatcccacttatgtctctgggttcccactttcactttttttctggctagaaaattccttgtgtatttgacagttcatagattgaaaaataaaacaattttaaaaatattttatccaggacttttggatgttttcagtggtagatttgtttaagaactagctttttatatgctcagaaatgaacatctggatcttgttttccaacacttttatggctgtgtccttactttcaggagcaaccaggaggacattctaattctattccttggttgtcagtgctctcctgaaatatctctaaataagttgataaatacctactgtgtgtctagtattgtgctaagttctatgaaatatcgggaagaccatgtagcttctcatgtagctaacagaacattggcagtagtggccttcagcccttggaacactgatttaaaccatattttcatttccaaacccttttaagccctagaaattagcatttagaatgatgtggttgtaagactgtaaggtacataaaggcagaggccatttgtatcttgtttataatagttggcacatagtagatgctcaataaatactgaatgaatgagtatctgggaggtcatggaggcagattccaatgctgatcagttcccatggcaatttaattagaaaattccagatccatgctcacaggtgtggaggagaaagaatagctcaatagcaggaggtcaaaccatcatgtgtttgggtcattggtatatcaagtttctaagtcaagggtccactctctaccataaagggcctcagggcacatgtaggtagtataagtcggtgattaagaacatggactctgaagtcagactgcccattttcatcctggctctgtaagttacgttgggtcagttacttaacctctttgtgtctcagttttcttaggttctacctatagagttgtaggaattagctactacatactaagtattaagacaatgcctggcagagaagtgccatgtactaacaattacttattatttctattattattatctccgttgttgttttgaacaccagtcacatcataaaaaatacattctcctgggagttatttgtcatttctatatgaaaatattctgagttttcatacttaccccttaggattttggagcctgccctactggagtatttctccaggtaggggttgaatacctctgtatctttttttttttttttagggaaatatattaaaatacaggatgctgggccccatcccagttggtccaaagaaatttctttctctgaaactctgtgatgaaaataaagattctacacattctctgtgtgttgggttagccaggaactgctgcaggtttaagtttaccatccttcagtgctgatggaaaatctgggagcaggcttggagcctgagaagaaatagagaattggagagttaaacagaagagaagagaagaaagaaagaaatagaaagaagtgaccagagtgtactcatgtcaggaggtggtcaaatcccatccatctctggtggcctccaggggatatgtgacatttgctttcccttgatttagggatttatgaacctggctccaacttaaagcagaggtcatggggattgttagggggagatgttagaagtaacaggccagggaagcctgcctcacaaatgactgccaggcccactggttgcctttaagcaatgacccccagggagtagattaaccagattcccttcttggcagatggtggggtggggggttaggctgagtgcccttgagctgttttgactggcctgaaagccaaatccagatgctttcctgcttgcctttgctctagtgctagtggagggttggcatttatatcagtcatgccatctgatgctcaggtcttttaaagacattacaatatgggtggagggtaacacagactacctgtgcggatgaagaactgggagtttagtacctttcctctcatacctactgctctacatggcctaaattttctgggtggaatctgtaacccagggtagaggaaaatgatgtgttggtcctgtcattggtggaaaggggcctcgttgatccccttgttccactacctaagcaggaatgttaggcctgggcaagtcagtctgcaggcacagtttggcctccacatacaagccaattttcttttgacttgcagctgccctggttcctcggtaggcttttgaaccatctctttgattaattagactttcctctgagttctttggagagatctgtacaaatactaactttcccttattgagtaaaaagtcaaataatgtgttcaggactggacttcgaagtcctgaaacaccatcttgtatactcaaaacatctttcttttttgtgtatgaaattcaacctttgtctcagtttgaagaagtgataaataaatttgcattttgtgaatttggagctccctgagtccattttgatggctaggtagtacctatattatggcagctaggtagcgtaagtccttccgttttcatagtagactttatttcttttccatcagggagcagcctgaagtatggaacagacaataatggttaagatgatgggttcttgagccaggttccctgggttcaaatgccggctgagccacttaataaacccaagaccataggcaaattatttcactgaaaccctatccctttttcttttaaaatggaccttggatacacataattggagtaatcatatttctaatccttgactcatttcatgctgcaccattcgtccatgtatagcctgctttaattttatttatgtgtgcatttacttttttatggataatatgacaactgtgagcccaacttaagaattagccacattgatgagaactcagtctgcctgtgtgctgctcccccaatcctgctctctacctccctctccaccctgaaggaatcgctggcctgaattttggttattattctttttctctttttgaagttttatctctctcatatgcacagagatatttatattcatattgatgtagctatggatatatagatatatacatgtagatatatcttcctaaataagatattacttggttgtttttctggccctcataaaaagggtattatgttttaggtagttttctggtacttgcttgttttactcatcattatattagtatgattcattcctgccacagagtataactgtagttacaatttcactgtggcataacatttcatgttaatataccacaatgtatttctccagtctccttgagatgggtttttggtcatttccagtattttactatcatgaaaaattcctctgttcctcagttttctcatcttcaaattggggaataaccataggagctaccacataagggtgttatgaagataaaaggagttaaagtgcttagaacaagaccttgctcatagcatattgttggtccgtgtattggtttgttagggctgctatgacaaatatcacagactgggtggcttaaaaaacagaaatttatttcctcacagttctggaggctagaattctaaactcaaggttttggcagggttggtttcttctgagggcctctcttttccactggtgagtggctatcttctcccaatgtctttgtagggttttttcctctgtgtctgtctgtgttgtaatctcttcttctttattgtttttttctttttagttggagtcttgctctgtcacccaggctggagtgtaatggcacgatcttagctcacagcaacctccacctcccaggttcaagcaattctcctgcctcagcctcccgagtagctgagattgcaggcacctgccaccacacctggctaatttttgtacttttagtagagacagggtttcaccatattggccagcctagtcttgaactcctgacctcaggtgatccacatgcctcagcctcccaaagtgctgggattacaggcatgagccaccgcgccctggactgtaatctcttcttatgaggacactggtcatattggattaggacccacccatatgacctcattttaccctaattaccttttttaaaggcactatctccaaatacattcacatactgaggtattgagggtgaggaattcaatgcatgaatttggggagagacacaattcaggccataagagtcagtaagtattcattatgaccatcattctcttcaccctcctccttatcattaaagctcaagaaaatgcagcagacttagttatgatatatcccctaggaacactattatgtgaactattattattatccttaggcagaccaaacaccagagcttccttcccggccttttcagaaatgactttggatacttggataccagcaacaagtactcaaaaatggtaaattgtggtttcttaagatgataggcagcagctccttaagtcagttagatgtgggaggaggagagtgaggaggtttcatttccatcttggttaaaagaaacagctaagtgagctcttgtagagtatctaatggtatacagactcgaaattgccacttggtaaagttctatgggttttcctgaaagaggcaggcagatctggtttttcaaaccaggaaatacacttgcacaagtggctgtgccaccagaacaaacagcatcttttatgggctcaaagtatttgacattagggagctggctaggggaaggcacctgatgaccacaactctgttcccctgctctctcaagggctctaagcactaaggaggaagtcaggagtagccctgatagggtttggactccaaaaggaaggaccagccagacacagtggctcacgcctgtaatcgcagcactttgggagacagaggcaggcagatcacttgaggccaggagttcgagacaagtctggccaacatggcaaaactctgtatctactaaaaatacacacacacacacaaaatagccaagcacagtggcctgtgcctgtagtcccagctactcgggaggctgaggcaggagaatctcttgaactcaggaggcagaggttgcagtaagcctagatcacaccactgcacgctagcctgaacaacagagcgagactctgtctcaaaaaaaaaaaaaaaaaaaaaaaaaaggaccagtggctgcccccccgcttaattatgcccccctgccctttccatgtcagacgatgaaaattagatggaatagcatgtgcctggcagggctgtgggcatctgtccttactggaggtgaggtgaggagtgggagtagggtctcgagggaaaaatacaatgagaacaagggatttgggggtctatggatgccccctttacacattattttcttaacaggctgtgattctccaaaggagggaattcttaaaaactagaacaaattaacactaatcatcattaataatttaatgcatcctcttggataaggattcctgtaatgtagagatgtaaagaatgtaacataaaagttcccacctcctactccccagagagaattgctgttaacagtttggtgtacttatcttttaacttttttcatcctttaaaagaatttagctacatgattaaaaatgaatacattcatttgttataaaaaatatatatatacaagtatacagagcccaaagtcaagatcttccctttcctatcccagtctctcttcctcaatcctgtttccttctccagtttggggaatagtaactgggtgctatcttagatccattttatatacacccaaaaatacatatacaaacttattccttttcttctaaaaaaaaaaaggatcatgccttatacaatatagacttgctctattttacctagaaatggttgtacctccttaacaacaacaacaaaaaaggtggagtaatacatcttccagagtgttttttgatgactgtcttactgatgatggtcatttaggttgcttttttaaattacaaattttttgtaattataaataatgctgcagtgaacatctttatgcatatatttttgtgcatgtgggcaagtattgctgttagtaccaattcctagaagtgaaattactgagtcaaactgaatgggcattttaaagttttcatagatattgacaaattgttctccagaaataatgtatcttgtttcttcttcggtgtactgtatcttggggtttcaccatattagttcatacttttatcatttaaatttagttaaatatttaaaaattcctaagtttttactatacaaattttcaaacatattgaaaagttgaaatagtagcatagtgaacaatgactgtacatcctccagctagattcaacaatatctaacatttctccatattcacttcctatctaaatttgctgaatcatttcaaagttgcagacatcttgatgcctcagtctaagtacttcagcctgcagctcctaagactaaggacattctctcgtataactacaataccttaccacaattaagaaaattatcaacatttctataataccatctaccttatttaatcagcttacatttaaatttccttgattgtcccaagaatgtcttttaaaaaaaaatcaggatccagtgaagtttcaagtattgcttttgattattccatctctttactggttttcatttttttaacctaagaacggtacccccttcttcatttatgatactgaaatttagggagttattttgtagaatgtcccacattctggatttgaatgtttccttaatgacaccttcttatttttaatggcaatgtggtattctgtaccatgaattcatcgtggtttttttaactagtcccctattgatggtcatttaggtcgtggcattccttttgtggctcctctcacaagtggtatttcgtcctaaggagtttgtggccccagtaggccacagttaaagtctgtggtcagttaatgaagataaagtgttccaaaacctaacttcgctggcaggaacattatcaagggcagttgtaaactgtgaattgcatcctttcccctctaaaggagatggattatcttttttgattccctgatttattttgagaggctgtagtctagggctgagctgagaccagggttctgtctttgtaactacctattctcacttggcacctgatcattaaccatggactcttctggtaaggccaagtcacctgaggtatggtgtgagctcccttaatttgcagtgtgcagccctccctcaagcagttattctcacttcagcctgttcttccttcctcatctcctgggatcccaaagctaatatttccatctgtgctttgggtcctattccctcccacctgcttccagtcctctcgctgtctagtgcctcctgccccttatgcttctccagcatctccctgtccactggctccttccttcagtctatacagaatctctcctgttcttaacagttatttctcaatattgataccaccctttagttatagttttcatctctctccaggcatttactcttctcaaaagattactgaggaccaggggtccaccaaatggggtgcaagagatgttccattgggtgtgtgaagaaaatgttagatttctattctaataaaatttcatccttttaaatttccatgtttgtgtgtcctgatgtacatttaggtgtgcatattttataatttacagttatacatgtatatcatttgccttactttcgattcttatcatcctctctagcccccttcagatccacacccacctacattctcaccgatttatgagcttctctcccaggcagtcacactggcatcacaaattcagcatggccccagcttcttttcttgtacctcacctcctccaatctgcaccctagactgtaggtcccaacatagggagaagccccaacatcccaccatccatctaagccatagcctgtgagtcatcttcaacttcttatcttctcttacttctgcacaataccctgtccagtcaattaattagtcctggcaattcaacttccttaccttctctcaaatctgcccatcctctcttctctcgctgtgtctgcctttgtttaggcattgctatcgccagcccctaactggtccctctgcctcaagtagcaaaccctgcacacaaccaccaaaaggagctctgcaaaactacataccatgcatgcctctcactcacttagaaaattcaaaccaaagccaatacatgatctacagggcctcccatgatcttttcctgcactgatattcttgccttatctgttagcctcctcaactagactatgaactgttgtagggcaggggtccctaccctgcaagatgtcttcattattgccacatagcaagaggcaagcacattacctgtcacctaggcgtgccttaataggtgtttttggtcaacagtatgaaagtgagaataggactgttttgggtaagaacaggagagtggagttgaccttcctttgagaaataaagaagtttccagtgagaaactctggcctatagataggccaaatgaatggactgatgtggggagctaaagttaccctggtagtcatctgataaacatactaatgtgtgacttaggactgtgggacaggcccaggtgataccatctcttcttgctaaggcagaatgatgaaatgaaaccccagcttttgacctagaaagatgtggcattaagtcttactgcctgggatggaaattctggctttcctggttactggctggattgatgttgaaaagggggatagtgattataacagccagcatttaatgagtacttactatatgccagcactgggccaaggattctacaggtattatttcaccacaactggatgaagtagatactgttattcccatttatgaataagtcaactgaggctcagcaaaattaaatgatttgcccaaagttgtatagagaataaatgatggagacagaatttcaatctcagcagcctgactccaggctggagataccgattgggagtcatcagtatacagatggtatctagagccaggaacctggataagattacctagtgagtgggagtagctatagaagaggaacatggaattggttcttggcccctgtagtatttagagatgagggacataggggaaattcagcaaaggagattgagaaggaacgccattgaggtagagaaagaacagagggtgatgtgcgagaatcccagcacagaaagtctattcaggatgagggaatgatcaactgcatcaaatactgttgatggaccaagtaagatgagacctgaaaatagaccaggactagtatttctagttgtgcaggttgttaattgcataatggagtgagtggtatctagaatctctctgacaccctggcatggggttgagccttggcagaagaaggagagcctatttcacataaagacgccatgtgggctaacttccatccttgtgttgcctactggaattagaaacatggaggtcattggtaacctcaacaaaagcaatttgagtgaaatggtaggaatgaaaatgtgattgaattggatggaagaatacttcagaggaaaggcagtgatggcgatgagtagagacatctctggaggagttttgctgtaaagtataaaggaaagcagagaaatagaggtggaagctccattactaccacaaatggaagtgaggtcaagagcttttgtttctttagatgaaaggtattttagcatgtttgttttctgatagcaatgatccagtgagaaaaacagacaattgctggtatgacattcttgagtaggtgagaaaggataggatctagtacaggagtgatggtactagccttagccagcagcacaggtgcttcctgcatagtagcagaggaaaaagcagctgtggggatgggtgcagggaggagggaggtatggaggtgggagcttatgcatgttatcttctaatggctctccatgccccctcacctcactgaaataggaaaccatttcctcagctgagagcgaggatggggaaggtctgaggaaagcaggagaagttgtgaaatagtggcctgggagagaggagagtaaatggtcttgggaatatagtgagattgtagagcagcatgaaagtctggcactaagtttgttgtcatgaatgtaaagggttaatagcatggctttatatttttctccagacatgtttgcttgcatgggtttagggatgtgaagtcagacagttggatttagccaggaatgtggtattgcaaggtaagtaggacaaaaagagagagtgtgtcaggagagttgggaatgtactgaaggaagtgatgggccttgaactcaatgctggtgagcatagaagtgaggacatgaggttggtgagggggcagtaaaaaggtggtaggatcaagactgtaggtcctggtgaagtgggaaaattgtgagagtagggatattagagggagtgaattggccagacacaaggtggtggctggatagtagggtgcatgacagaggttatggagagatcacagccattaacagtaactggtgtgaccatgtgaaaaaggtgtgaggtaaaatggagaggagaccttgaggagcatggagggcaaggcattgagaggccagggtgttgctaaatattgataccgcagagattttgacaaaggaatgttggaaaggcatcacagggaggggaaaggcaaaaccttcaaggactgaagaagggagggtatacatggagggggccgtaaatccgtaaatgactgcaacagaaaggagtagtgggtgccatagtctcaggacatgagattcaaatcagcagagtggttagcaaggaggcagagagaatggtctggaagagacagcaatttagaaacatctgtgaggcacagagaggcactcccttggcccagttgtgtaaggttatatgagaagaaaaacccccactacttgagagagctgtcaggatagcagtgtcttcagagaggaagaactaagtttttcttaaagaaaaaaggtgaagggactgctcaggtgactgatgtaaacagggaagtaggggcgtggtgggatcagtggtctccatggcagaggacagtggtgtagctgtcagggttgtagagtgggaggaaggaggttgagattctttccacgaacagagtccacgcacctactgtttcagacagtctaaactctagagccctagagaactttaccactctggtcttttgattctaaaaaggatgttgacttgtgagaaggtagttaatgacctgtgttgcttaaagcatttttattacttttgactttaaattgcattgatgcaggactttttgtctataacctcaggattcctccagctgaaaaagaaccaggctatgtatattagagtggaattccaggtatgagttctctagtgtgtagaaatgaattaaccaagtggaactctttctagggaagtatggcatttcacagatattacttgtaaaatggggaaaagagggtcaggggaggctcgctgagaaagttcccagaactcagcccagactcggtgctcagtaaagaactgtcttagctgggcatcatggtgcatgcctatagtcccagctacttgggaggttaaggcaggaggattgcttgagcccaggagctcagggctgtagcatgccatgattgtgcatgagaatagccactgtactgcagcctgggtgacataatgagaccctatttctttaaaaacaaaaacaaaaactttttcctccattattgattgccctttccccctgtccctgtgcctattgctgtttctttggatgttatttaatttctctgtgccttagtttcctgtatgtcagatgcgcatgatcatagtccctacttcataggaaagttgtaataattaaatgagataacactatgtgtattagtccgttttcatgctgctgataaagacatacacaagactgggtaacttataaagaaaaagaggtttaatggactcacagttccatgtagctggggaggcctcacaatcatggcagaaggtgaaaagcacgtcttacatggtggcaggcaagagagaatgagagccaagtgaaaggggaaaccccttataaaaccatcagatctcatgagacttattcactaccaccagaacagtatggaggaaaatgcccccatgattcagttatctcccactgggtccctcccacagcacgtgggaattatgggaggtacaattcaagataagatttgggtggggtcacagccaaaacatatcaacgtatagaaatatttaacacagtacatggtacataatataagtacttaaatatgatttgctattaaatgacaagtggtaagttcttggctcccattcaactctcttattcttgccattatgtttcttcttacttcaccccctttctcttacatcttcttccctttctctccttctttttccacacttcctccttaacctatttcctctttccctcccctggctttggttgcagtggcatatgcacctagttcagtactctttgtggccccctgaagtagagaagtcttagagtaggggtgaggcagccatcagaggaaggaaactgctggtggggacagtctcttggccattccatctgaagtctgtagtgtagccatggtggctgcagagatgcaaagggccagtgacaagaggctcaggagctgggaggcctatgttgcagggcaagtttggctactgtgtgatgtgtggctggggcaccagacagtaggcagagcatgctatgaagatgaggatcatttgaacaggaagggactgggctaaatcaccatgtggagggacgagtgaggacatgtgcatgtcctgcccctggtcctgttgctgataccactatgactactcccattcataagggtggctcctccccacggggcatctcctgtcagtcggccttctgtgggagggagcgagtgagcaaaggatagctgagtgtgctggctaagactataaattctagagccaaactgcttggatttgaatcctggctctgtcaccgaatgagaatgtatccttgagtaagttatctaacttttctgtgcctcagtgtcccatctctaaaatggatataattggaacaatacagttcttatgaggatttgtttaaattaacagtttacaaagtgattttcatagttcatggcataaaagaagtacgatgtgagtttttgttatattttaaaaattttaaaaatcatacaacaatcttagaagacttactttcattttaccgatgccaaaacggaggtggagaggttaagggccttggccaaggccacagagctaccgagcagcagagtcaaatctagaacacagctttgacatactccaaagtcctagcttgtaactgcaatgcttaactgcctccctggacattcaggtggagactttgctttctaggagagctgggaggcagggtgaggcaggtgggcaatgtgagtcaaggtgggtggtcagcagttggagtctgagaggttgggagaagtactgcttgaggacacacctgggactagtggctgcatgcccttggcccggctccttggttggggagagcagcctggcttcccaggcccatttcagggacaggtcaagtcccttaggtgcatgaaggtgctgatttcagccagagagctaagccttcttgggactttttccttccttccctattttccaggtgacctcagtgaagttaataacccttttgcacctcagtttcctcatctgtcaattgaggataatactttacctgtctgcttcctgggtattttgagacattgagtagattgtggatgtgaaatcatttgaaaagcataaagcagtacctaaatttaagatactagagtgatctcagaccacattactgtgagggtccagtgtagatctctcaggcctctccatagctaccttgtgctgataatgcccagtgtccaatttcatgaccttttccagctggggtctacagtgatacttggactcttacctccttttctcagtttttacatttcccttggtgagtgtaaagtaatagttgagcagcatgtgggtccctgggaaattattttccgtgtggatttttatttttaagagccagagccaacgtctgtgtccagcctccacagttgtcccagctcccattctgggagctctgccatcttcttggtttcagcccttggcataagacagacctgggctcctgtggctggggagcctgtaactgcctcctctcattagcagacagtcttggttatgtgcttgccctgtggggaacagggaggcagctgaccctttcccctgggtgcctttgtctgtcctggcatactttggggtgtgtgtgtgtgtgtgtgtgtgtgtgtgtacacgtgtgtgtgtatgttagagattctgtaagcccaagaggctaggcctcttgtcagctgccaaagttcttttttccccagaattgagttagccacccaactgtttccattctctgcccgctgcgaagctctacagcagggctgctgtggcaggtcaaaacatgctctgctttgagaatacagagattccattttgagagagatgggaaacaggagcgagtgagtgggtgtgttggatgtagggaaagtgaggacattctttttggtaagctgtgccaaaattggcccagaagcttggtctaaactcaaaagtagggctaatgctgggctgacacccaaatatccaatggggaaagtttattcttggatctagaccctatgagacctagcaatcatttttttttctcatctggaatatggggataattctactccatatattcttcatgtcaaatgagaaataaacttgtaaatagtctaccgtctagtctccaggagcaggaagtgacataaggttgtgattcttaaagtattttgcagaatacaaactgttactaaaaaaagaatcacttgctaaataagtttggggaacactggataaacaatggcatgttttttgtctgtaggggccactcaggtccttcatattccaataatacacatgggaaaccaccaaggggatatattatatactacatctcctaaatttttaaccaaactttcttagtggagcatttacaagtaccttctctacaaaagacatctaggaagatcctgatctagatcagaagaatattcattttgttcttttttttttcctgcaattgtaaagagaagtgaattggtgaaatgcatgggattgctgaaatatgggtcctgaacagcaggggaggtcaactttggactctgttgaaatgaatgcttcctgctctaaaacacttctctccctcctatcctcacagctcccctttgaattggagatttactacattcagcatgttatgctctacgtggtacccatctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaatttttattagatactgacaaattatgcttttatatatgtgtagggtacaaggtgatgctacgctatatgtatacaatgcagaatgattgaatcaagctaattaacaaactatatttcttacaaaccactcccaaccccaccggcagctctgcatggggcacagagccttcctgtctcttgcctacagcttcctctaatggaggctgctctttctgccctgccccatatgctgcagagccccctctgtctcttctagagcactatctcatctgtacgttaggggaaaaaggctttctcttttactattctctctctttttttttcatcaccaccatcacttgacctcttggtcccttcccctatattcctagaagtcactggcctgtagctctcaatatttccattataatttgagccaacatcctgagagacttcttgtaaggaccacccatccaccccagcttctcaaggtttgggcttcttaattgcagtgacctcagcattcccttcttttcagccaccaggaccttgttttcccgtaaagctcctctatgtgagaacgtaactcctgttatgttctttctttgacccaaatctccactcctttcctcttcttcctattcagcttgtatctccatgacctatcattgaaactttcactagctcctgaaagtgtctcacctcccttgtcccttccaactgggatcagtgtcccatgccttttcagtgtgcccagtcttggcctactggaggagctctttcaagccattctgattagggccatgaaaatttcatgatgtctattataattgtgctctcaacaccattgctcaatttattttctgtctatggccagctcctccacacattgccctcacaagtcctgtgctaaatctttaccaccctcctcaaatttcctgtctactctgttcaaaccttctgttctctccaccctcaatagatcccccctctccccacaaatgactgagaaaattgaggttttgggatggaaatttcctcaacacttctctctacctctacaagcttctttacccacatccatccctatcttcctccttctcatcctggaagaaatggtgttcattctgttctggccaataatatccctgtgcgattagctcccacccctgctaccacctctggagcctcattctatcaattaatcacttatgtacctggatattctttttctttctttttttttctttttttagacagggtctcactgtatcacccaggctggagtacagtggtgcaatcacgactcattgcagcctcaacctcctggcttacatggtcctcccacctcagcctcctaagtagctgggactacaggcacatactaccacacccggctcattttttttttttttttttttttttgtattgtgtagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctcttcccttcacacctaagcatcctaaaagaataatctaaacaacattttctaaaatttagttctttgggcaagacaatttttgtcttatccacgtaaccatgtgtgttattatgtatgtaatacatgtccttaaatctattgagttttttttttttaactaaaatatatacgctttcaagagaagccccataatatccatgagattgtggctttgatttactggttatctattttaacacagtttatatacaaaactattaaaaatgaaatgtttatctgtttgccacctgaaatcacctcatacatggtgcataactttgggagacactggggtctgcccttgagttttcttctcaattaccctttattcctcagaccatttactctgatatctaaccctctaccagacttttcacagaaatggtgcttctaaagatcaccagcaacgtctgtctgaccaaatctaatgaccatctctcagtctttatcctacggaatgctgttgcattggatggtattgatcactccgttttggattgctctgcttcggggcttccaaagttcctccctttcctggctttcctacctcaccaatcatgtcttctcaagtctccttcacaggttattttttctcactcctctgagatgttgagttctgttctaggctcacatctcattctaattgtctggtatggttttgcctgctttcacggtttaactactagtctgtctagttatggctgctacatcactgtctacagctcagacttacgagagtcacattcatatagtttactcaacttctctacctaaatgtctcaagcatatgtcaaacccaacctgtctgtgtcaaactcattatcttccctgtcagccctcctgctcttcttgtggttcgtgccaagtagcagcatccaatcaccccagctaaaaactgggaatcatccctgcctcctgtatgcaatgcatccgttcatctcacatatattaacatatgccttcttcctgccaggatccagactgaccactggggtgccctgataagcaaaaatcagacaccaccctgtccttcataacatttataagctagtgggggtggagtggggagatggatatgaatcaaatatcacatgaatttatagttatgactgagataagtactctgaaagaaaggaacatgctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccatatagttccctgctacaactccacgagtaactactatttttggtttttgtatatcctcccagagtttgtttttttgcatatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaactatatgccagatattgtcacacacttttcccatgcattaactcatttaatcctataacaactctgttaggaaggtgttattattatctcccttttatggaagaggaaactggtactcaaatagcaagtgacagtccccggatttgaagccagtagtatggttccacggttcttgcttttaatcataacacaaagttacaacactatatcataatttatttttttcagtctgctattgatggacatttaggttgtttcaaatcttttgataatgtaaataacactgcactgaaggaactggtacctttgccattttgcgtgtgtgcaagaatatctataggatatattcccagaagtggtaatgctgaatcacagtatatgcatttgtatttttgttggatatttccaaatccatgaaagttgtaccagtttaaatgtttactagcaatgtatgagagtgtctgtttctacacaacctcaccaaattggatttttgcccatctgatgggttaaaaaaaaaaggtatatcagttcgattttaattttaatttcactttgagtgaagccaagtgtctttttacatatttaaaattggcatttggctgggcatggtggctcaagcctgtaatcccagcactttgggagaccgaggtgggtggatcacctgaggtcatgagttcgagaccagcctggccaacatggcgaaaccccctctctactaaaaatacaaaaattagccaagtgtggtggtgcgcatgcccgtattcccaggtactcgggaagctgaggcatgagaatcgcttgaacccaggaggtggaggttgcagtgagccgagattgtgccactgcactccagcctgtgcaacagagtgagactcagtctcaacaaaataaaataaaataaaattggcatttgatttcctcttccttgaactacatgctcctatcacatgctcattgttcaattgtgttggcctttttacaaaatttgaatcctaagagcttgttacatataaatattaacagtttaccctttatgatatgagctacagatattgtcctcagttgtgttttcttttgactttgctaatgttttattcttgccatgcaggattttaaaatttctttttcttcttcttttttttttcttttcttttcttttttttttttttgtctgagacgtagtctcactctgttgccaggctggagtgcagtggcgtgatctcagctcactgcagcctccgcctcccgggttcaagcgattctcctgcctcagcctcccaagtagctgggactataggcacgtgccaccacgcccggctaatttttgtatttttagtagagacggggtttcaccatgttggccaggatggtcttgatctcttgacctcgtgatctgcccacttcggcctcccaaagtgctgggattacaggcatgagtcaccctgcccagctgaatttttacctttctatgtaatttatcttttatggcatctgaatttagagtcatggttagaaagccctttactactccaaggttataaaaaatatatatcccatattttcttctggtatgtttatagttccttttattattattttttacatttaagtcttttattcacttggaatatatcctgatatacagtgcaagataaagatccaactttatttccagctggcttcccatttgtccccacactgtttattaaatagtccaacatgatccaatctgcttgtggagaagatcatattggctgctgtgtggagaaatcactgggtcctcctgctcttacctcctaaatatctctcagactcatcctctccttaccatctctaggaccagtaccttgggccaagccttgcacatctcttccctcaatgatgataattggctctgtgtgatctctctccagccagcctcctttgctccccctaagcccattcctggagctacttctatagctcaaataggatcatagctctttgtcatttggaagctttcagtggccccccatcttccccagtgcacaagaccgtatgacctgatacccaaccccttctccaacctcatgtctttacactcccttctttatactgtacactgtggtgatacccaaatccttggggttccctgagtattttatccaattttcatgcctctgtgcctttgaaaatgctgtgatttctgccaggaatgctcttctccagctgtgggcctagaaacattcatttgtcaaaactcatgtcagtagttactttctccaagaagccctctgtaactattctaccccagctcccgccagctgcctctgttcctcccatttttgtcatcctcacagtatagtctttacatgctggtctccctgaggacaggaatttttcatttcttcttggtatgtaggtgatgaatgaatgaatgaatgaccttctattcagggatgtattcctgtactgcaaattgcacataatttattatacatcttacaagctaatgtttactaggcactgggtttgttacatgtgtgatcttgatctcatttaattcccacagtgtccactagacttatgggagtacatcacgtgaggcccatgaccttgaatgagaaaaataatcacatctttatgtccattaactgcaactgaaatacagtcatctctcggtatccatggggaattggttctaggacttcccccaccacaaataccaaaatccaaggatgctcaagtccctaatgtaaatgacgtagtatttgcatctaacctacacacatcctcctgtatactttaaaggaagcttgtctaacctgtggcctaggatggatttgaatgtggcccaacacaaatttgtaaactttcttaaaacattatatttgaaaaaaattttttttcagctcatcagctatcagtagtgtattttatgcgtggcccaagacaattctccttcccatgtggcccagggaagccaaaaaattggacatccctgctttaaatcatctctagattactcataatacctaatacaatgtaaatgctatatacatagttgttatactgttttttatttgtatttttttttactattgttattttcatttttaaaaaatatttttgatctgtggttggtcaaatccacagatgcggaacttgcagatatggagggccgactttgtggtatatcctttagtaaggaatgtagataacaaaccacagttacattagcagcacttggcatgctgttgttaatgtaaattacacttattttcctcttatgttagagttgttgcagatatctcaaaaaatcattggcattcatcattacctcaaaatttaaaaacagatgtgccttttaaaagcattttgataactatagttcaacatgattattttcttttataatcctatatattctatttcgtatacttaaatactttattctgagagagagcctttacacttccccagactgcccaaggagtgcatagtaccaccaaggttaggagtccctttactagagtttattttatttttatttttttgagacagatactcactgtgtcaccctggctggagtgcagtgacctgatcttggctcactgcaacctctgcttctcgggttcaatcaattctcgcacctcagcctccagaatagctagaagtacagtcacatgctgccacgcccggctagtttttgcattttttgtagagatagggtttcaccatgttggccagggtggtctggaactcctggcctcaagtgatccgcctgcctctgcctcccaaagtgctgggattataggcatgagccactgtgcctggcctgcactagagtttaaactggtgtttgaaaccaggtgggcagagatgcctctatgctgcctgtccatggagtcgctggattcagacagactgtaggtacaaatcctagttatcccacttgctagttagttctggcatttggtcgagtaccttgacctctctgtgtctgttttctcacttgcaaaatgagggtagtaatagtacctacctcatagggtgttatgaggattcactgagctgatacatgaagagtatacagaacaatgactggcacatagtaaatactatgtattgggtttgtataattattaattacccactgttctgccttgtgttaattattcatctttcttccaactagactgccgtctctagaggtcaggattgtgccttgctgtgttctaaagccgcagaaccttgcatgaactgagagcatgcttgtcagtggatgtaacattactggtcctccctcctttgagacacttgtttctcctttgagctccagggtacctctttctcctggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctccttgtacttttattatactttattataatatgcagtaaccaccatttctagttgtctgtattttgccactaggtggcagtagtcacatcttttcgggagattaagataattaatattggatattgatttattttatttattaaagatgttgattaataattgttgtaattgaggtgctatgggaataaggatgcgggtaaaatccgtgaggcccctgaattttggcctgagtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagagagaaaggggagtggatgaattacaagttgatgacaactgctgagaatgacaggggtttggtggtggattgagaagggtaatgacaagagaaataagtgctgtgggaaatggaagaaggagataagcctagactctctcaacactgtccaatagaattctctgtgatgatgaatatatcctatatctgttctattccacatggtagccactagctacatttggcttttgaacagttgaaatgtgcctggggggactgaagagttggatttctcattcgattttaaggttaattaatttgaattgaaattgattggttggttgattgattgattgattgattgatgagatggagtctcatcctgccgtccaggctggagtgcaatggcgagatcttggctcactgcaacctcgacctcccgggtttaagcgattctcctgccttagcctcctgagtagctggatctacaggcacatgccaccatgcttggctaatttttatatttttagtagagatggggtttcaccatgttggccaggctggtctcaaactcctgacctcaaatgatccacccacttcagcctcccaaagtgctgggattacaggtgagagcaactttgcctgacctgaattgaaatttaaatggccatatgtggttagtggctattggacaacatagctctagaaggttggtgactggcactgtggggccctcctgaaagaagaatccgtggatttttctggcactggtttgtacggttaccccatttggggttcagcagcctaagtggaggtgcaggacatctggctggagggatccgtccaatgttgaggctttgtaagtagggtcagtattgttgaaaatctagaaagtgagggatgtttgaggggttctggagagttttggtaatcctgcaacgcactgtattgctttcaggtttctgaccaaggacaggtcacccaaggagcaatagcagaatgggagacagagcagcactttattattagctgagcaggcatccagtatctttagtgctgggcgagagcttgcagctttgttctcaacatctaggtgagcttcccactctgtacctagagaatataatgtggctagatgtgtagcacaggcccccccatactttccaccctatcaaaggcattgagaagctagagaggaaagtgaagaggcctggctatgcagagagacaggttctgctgagatgtgcacgacgaaatacacatgctgcccattacaaagctagactacctggtttcaaatactggttctcctccttactagctgtgtgactttggccaagttcccttaccttctccaagcttcagttttctcatctgtaaaataaaaataataacagtacttcctcatgtggttgtaattagcattaaatgacttaatgtattaatatataaagtgcttataacagtccctgtcatgtaatggtggtatataagttgtttgctattattagtatggtttcagcttgccaatatactgtggccctgcctactaatctaataaaatgtggtttgagcagttttttaggttctcacctttagtaagccaccctttggggatgatctagtgaggggatagatagaagtgtggggagagggggatgaagagttctgcttcccaccagggagttgagagtgctggtgtcagagttcgaggccatggggtccaagctggtgtggaagaaaggctagaagagagctggggaacaaggaggaattctatggagggaggtaaggagcatcaagggatcacaggtcacgaggaggtctaggggcatgcgcatagtaggaataaggatatgaaagctgaactgtcgggaggttgtggtcagatgatcccagcagaggcggggcagttcaaagtgatgacagaaggcaggttgtggttagtgcggtggagtagacctgtagagttgaggaggttcaggaggccacgaggttagggtattggaagaggtgcctgcatggatgttaaaatcacccagaatgccatcaggaaaaggtataaaagaaggtggtaagctaagtgacactgatctgaggtgaattcaatgacctggaggccaacaacaggtgacagtgacaaagaggaggaactgaatcttgaaagagaacgagggaagagtaaacgtctagaagcaataatggagggctagaggaatcttcaacttcccttcccccacaaaaaattgctgcaggaatagaaggattaaaaaagaacagccttctcagagctgttagtggaagaaatcacaccctcagtggacagccagggttccttagggtgaggaggtgaaagggacattctggggaaaggtggcaggtatagacagattggttgatcataaacaccccaggccagtggtggtggtgggcttccagaggttctagtgggatgggttgggaggaagtcagccacaaggtggttggaggaaagtgcccacacagctttaggcccacagcttggtcctgcctacagctggtgacacaactcaggagttcccctctcttcatccttgtgatgtgtttcgattggttggttgtgtttgttttcatttcggcagcagttcttaacctggggttcacaaataggatcttaaggggttcattcacttgaatggggggaagtcacatctttattttcactgacctctagcagaaatgtagcacatgaacgcagacaacaagcaccagtggtattagccctacctgtgtctttgttgtcagtagcaatcacagatggcttcctatcacatttcagtagtagcggccatctcaggatagtgtttatgctcatctgctttgaaagtgatggtagttattaggcctgctgctagatcttgtgattaaatgtatttataaagaaacataattagtatattacaaaattttaaaaatattttggtaactgtgttttaatataattgaattcctttggcttttattttatgcatttcaaacactgttctgagaaggagtcctttggtctccccaggctgctggggtgcagggggtggggtggagggcctgcttcaagtctgctgggaaatccctttctatttcactagagggagctcttgtttcagaattgctgagcagtgaccctcaggcttgacacccagtaataaggttgtttttttgttttgttttgtttttttgttttgagacagagtcttgctccgtcacccaggctggaatgtagtggtgtgatcttggctcactgcaacctccacctcctgggttcaagggattctcatgcctcagcctcctgaatagctaggattacaggcatgcgtcaccatgcccagctaattgttgtaattttaggagaggtggggtttcactgtgttgccaaggctggccttgaatcccgaagtgctgggattacaggcgtgagccaccgtgcctgcctgagaaggctgttttgaaatacaggcaattcagatgtttttggaggacatttcaagaaactggggttaagaacctcagtgttgtttgttctaggcaggccacctctctcttgagtgggctttcagctcatcttctggaggatgaggattggacctcctgtgctagttactttctgggaccagttaaagcggaagtactttggccaatggcagctcaaaaactggccccaaggtcatgctgacatcagtatccaggctgagtttcctgtttctcctccataccattgagcccattgcccctcccatctagctagtgttaggatgttagagaagttcccctcttccatgaggcttccctgctccactatactggtcaggtaagggcaggtgaaagtataggaactctggtaaatcctgaggctcctaaagggttagtggatgaggggggacctgagggatttgactgattggcgaagggctgagccttgtgcaacaggtgggtaggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatgaggggaaacctgacttgagcctacactcagtggctaagaatggggaatcaaatattcacgatcatcttggggttgtgccatgctgagatatcttttaggcagccacagcttacaaaggctaaaaatggaggtatctcatttaaagagtaccaaagatgggaatacattgttgtcaggaaccaaacttgtcattctcttccctatccccaaacctgtaccttctctgatgttccccatccttttcagtgataccatcacctatttgttatccaggccaaaaatctaaagccaatcattggtctatattcctatccctgcccccatccaatcagtgaccacatcctattaatttgaccttctgatcatttctcaaatttatttccactactccaactttagttcaggtcagatcatccctgacttcgtttattgcaacagccacctaactggtttcccagcctctagcctcaccctgttttgtcctcagggcacataggatgaggcctgagaattggccattggatttagcaatgaaaaagtcatttgtgaccttaatgggagctgttttgatggagggagggaagcctgataagagtgagtttaagagagaacagtaagagagaggaattctaggtagggagtataccagtgctgtccaataaaaacatgtgaggcacatatgtaatttcaaatgttccagtagtcgcattaaaagcaggtaagagaaacaggtgacattaattttaataatagatcttacttaacccagtatatccagtattttatcattccaatataatcaatataaaaattattaccaggatattttcctggatttcctttgaaatccagtgcacattttataataacagcacatctcaagttcaaactaaccacatttcaagtgcccaccagctgcatgtgactagtaactaccacattggacagcactggcatagacaattatttcaaggaatttagctataaaggggagcagaggagtgaggtagtggccagatggggaagtgaggtcaagtgttgacttgttggttttagaacgggagctattaaagtactttccgtttatacactaatggacttaatccagtagagaggaagaaattgttgacataagatgacgaaacagtgactggagtgatgctgttgagtaggggagaggggatggaatctggatgcaagtggaaatgctggccttggctaggacacagggcagttcatctgtggtgacagggagcaggggagtgaaggaagaccatactgggcactgatgcagatagatgggtaaatgtgattgtggaagcttatggaagtttttgtctgattctttttttcctctgtgaagtgggaagcaaggttaatatctgagagtgaaaatgggatagaagtattaaagattcgagaagagagaaaatattaatttgtggcctaggagcgtgacagagtgaatggactggggaaatacagtatgattgcctggcaacatgaaagatgcacttgaggtttgtgatcacgaatttgaagtgagaacagtcagcgctgttgtttttctctagtacattcagctgtgagggacaagcaaggcagaggaggagctttggattcaaccagggctgggttttttttccagctgagtatcattccataatgagaagaacaatggagtcaaaggcgtatgcaagggataattagaatcatgggccatggaatttaaggacagaaaagggagccatgagggacagtaaaaagatggtaggaccaatggatcacagattccagtggggtcaaagaagtattggggtcatggttatcgggagtgagctggaaaggtagaagtggtggttgaagtgggaatgcttgacttggagattagggaggggctacagatatacataattataaggtctcaggcacgaccatgataatgagtggctgagatgtggtagagagcagggtcattgagaacaagaggccgaggaactgacagaccaggatgctggaaggttcatctagatgcatgttgaaattaacaagaaatctgatgagtggtagtgagccaggtactaaaggaatgagggccatgacccatatgtctgtagatgactgtgaaagggaaggatagcgggtggtacagtatggtagtggtaggattttagtgagaagggagggccactcgtctaggactacaatgaaaagaaagaagttattcactctacctacatgggccaaaggagaaaaatcagtcactactttagagggccacagatgaagcaggcaaggagaggtaggttgggtaacaacaaaagggtgaagggaacattcagagaagagattgagaacataggaattgagctaatgatttatctgtgattgttgcctatcctgttcccttttcctggaatttccttccttaccttgtacacatagagaactcttcatctttcctcatccagctcttgcattgctactttcctgaaacggctattgcaaagattactaactagtgatcggcatgttgccaaacccagtggaagtgcttgcctttactgtacccctatagagaagtgtgttcccagtggaattttctgtggtgatgggaatactctatctctgcactgtccaatatggtggccaccaggcacatgtgactgctgagtatatgaaatgtggctgatgtgactgaggaaccaaagttttaattctgcttaattttaattcatttaaatgtaattagccacatgtggcaagtggctaccttatttattggttggtgcaagtaatagagcacttaacattattgatcctttccttcttgaaacttgatgttcttttgacttccagcacacctctctcctagctttacgattgcctctttaattttgtcttcattcttgacttctcatggatctttctccttctgctagccacttaactgttgctattttccaggcttcctccttcagccttttatcacattttgtggactctttctcattgatcttatccataccccaagtcctgtttccaggccatctccctctcctgagcactagacctggacataacagcctattggagacatctgctggtgtagtggataggcattcagtgctggcatgctccaacctgagctcatctcttctctaaattacctcctctcagttactgaagccatagacctggaagttagtctagatgtctccttcctgtctgacaaattgccaagtcctctatgccactgcagtaccatttgaacttgtcatcagtcttgtccctctccagtccattgtccacattgctgctagagcagtctaggtagctgaaacataaatttgacctttttattctccttgttaaaaccttttagtggcttctcattgtatataagataaaggccaagttcccagcatggcaaacaaggctcttcatgacccagcctcacctgcatgtttttccagcttcatctcctgacatgtgtcccttctcacaaagttctctcctttccagtaacgcagaactccttctaattgcacacaaacagcatgctgtttcatgtctccacagcttttctcaggctataacctctccttccttcaaggccctaccctaaccccttctggttctgcaaagctcacctcaactgtcatcttctccagctacttttcctcagtgtccctgttacttaatgcacttacctaactacaccattgcattattcacttgtaaacgcaggtagttcccaagagtggggaccaccatctttgcctccttctttccactgtctggcatggagtcttactcccaatgtggactctgtagatgttgagtgaatgggtaccatgaataagtgagtgagttgaaggaagcaggaagaagattagagagtgggatgtcacactgcccagtctcatctccttagtataagtccttcatgggtgggattataggatgagaaaaggggcccctgggaggcctgtggggatcagtcttggctgctgctggtgcaactgacttctttcccaggactcataaaacttgcttctggcagaaattgattttagaaaaagctattatctaggttttcccctacctttacagctgacatgcttctctcttcctgggatataagatgctagcaaaaaatgtcacattttttcttaaaggagaaaaaggttttgtatgtttaattttttgaaagtgcttaagtttctgttttcttttagaagaaaactggtttttcactgggattttcccaagggccacatgcaggtatacagaaaagagaatgatatgtgtttgcatacaatttgcatatatctgtgtagactggatcatctattctcagagtactttctttttttattttttcaaaaaaattgaatacttgatcaacttttcaatgaaaagaatcagtaacagtgaaaggcaatggaagccatagtggaagtcctccttcatagagaagatcacctctttagaagatgccccatcatcttctagtcttttataagattttggatggttgtggtcgccatgataaaaaatagcagcagccatctgcatgccaggatagctgtcgtatatacttttatctctctttttccactcaccagcccttagaggtagatgttaccctcagcccaccagcaggaaaacaggcttagaggggcagcacaatttgcccaaggtcactcctatgggtagtggcagagccatgattcaaacccaaggctacatggccccaaggcctttgtttttaaactactaagctgtattttctgccatttgtgtactgcctggtgttttgtcttttgtccttgccattaccagccatagacagatacatagtttggctgtcatttgaatggtagtggactctgttgcacaatgttgaggtaccatagtttatgtaactatctccccacttggtttgtttccagtttctcagtattatagatagtgcaggtgtaaatatctttgcgcaaattagggtggtttgttggagtttttaggtatttgatggtggtccgcaaagtagtatttttgaggcaaagagttataattttatgattctccagaaagtctataccattcattcacccaagcagtgattacttttggagtgcccactgtgtaccaggtgctggacgtgaagaggtaattcagaaacagcccctctctcagagaactaacagtctggtatgggatggatgatgcagcacagaatgaatgctactaaagtcggggtttgggcaaggggcagtgagagcactgagaaacagtgtcccctggtagtatctctgagtgttcctttccctctgcagcatggggcaagacgggaggagcatgataacagggctggctgcagagctgcctcctggctgaggacaccccccaccaacacccacgggctttcctgccaccgcctgttggctcagtcactgctgcccatctgccactagggggcgccgagcagagaggatggagggagggggcacccgggacaacaggactgggggctccagcagtgggaggagtggcagcctaagcccttgtctgtcctccaggcctcctcttcccctgtatgcccaccgcagccagggtgacaacacggtgcccagtccacactcattcagcagacaggaatgtgtgcatgccttaagggcatagctctgtgcattttcacgcaccaagcactgtgctagatgctaggaatgcagaagtggcctgacatggtccttgaccctgagatgcacttggtctagagggttggacagacaagggaagagacaatccaacttgtgtgctggaggccttcacaagtggcaacaggagcgttgagctccctagtgagtcccctggcagtgcgtgagagttcatttctccagtgctccgctcttatgactttggctgtgacattgcccatcttctagcctggaatttctccatctataaaatggagggaatgatatctatgtctgcaagggccttctgactcagatgtgccatgagcctaaagcaagcctgagcttcttccacagaagagcccccagccctggtccccactttagtcactgaagaaagtctcctttctcttctcgcccacatgctctccttacatggttttccttggcattctgcctctggccttttccttctctctttctacgtatgttcccatgacttcagttaccactgtgtgctgatgacacctacatctccatgctcgcccccatcctctccactgagtttgtgactcatataacaatgaaaataatcagcatttgctaaatcccagatacaatactgtaattacggtatattatctcatctcatctctccaacaacattgtgaattaggcagtgccaccccattttataggtgagtagaaccgagttcaagagatgctgagactttcccaaggccccaaagttgataagtgatggggccaggatttgcaaacctctacctgttgagctccactgcccatgctcttatccatcacactatatgtcctagagtacaggcagccgccaaagacccatttccacttggatattccacatacacctcaatttcatgtctaaacttggcctcatcatttcccttctgtcccaatctgccttttcctctcttctccatggcaataaatggcaccatcaacccagtgataccccagccagaacactgggagttttccaagatccttcctctcccttaccaacccccatctccccaacaatcttctccaatcttcttccacatcatggtgattttccccccactctcctccagcctcactgctgttgccttccaaggccattcatcctgttctctttttgggctcctgtagcaatcttcttaccagcctccctgcctcgactctgtctgcttgagtccatcccctgcacaccagccagggtgatcctttgcagacacacgtgatcacctcaccttactgcttcaaaacttctgctttctgtgactctacagcagagctcaaagctggccacccatgggctgaaatccattcagaagacatgttttgcttggtccaaaatgttcttaaaacattttgaattagtcgccaacattggaaaatcaggaaatttcacataaaagttcatatatattggcttctcttgcaaaagtgaaaagaactggtaactctgggtgcacatcccttcagggcaatgattggatggagctgagtggtggttgccctctttagaaggggtgtgggcttttcagtttgacagtctccagcatcccctagtgtctcttaggccctggtcgcacccctgcttccaattatctgcctgagagttggggcatttgagttcatgaccctggtgcatgggatgaagcccaaagccctcagcatggcttctagtgtcctatgtgtcgcagcctggagcagaccagccctgcgaacctctgaggctagtacctgctaactgccccgttacactctcccctgtggccccatggaacccttatccatagttctctgaattgccccactcttgtctgtctccatgcaagcttgtgctttggaattcctaggcccctccttaagtcctatttgtccttctgggctttgcaccagtacttgctgtaccaagaagcattccttgtgcccctggctgagttttgttttcccataacaggtggcgcagacctcagtcatcccaccagctaccctgtgttgtagttgttgactgtgagtctgcagttgcagggaacctgccttctttatcttcctgtcctcaaagctttgcacaggacttggaatacacaaggtgcctcataactgttgaatgaatggatgaatcagtgaaagactgatttgggaaaataatagtctaggatatgatgtcaaccctaattgcttggggtgggggttccaggtccctttcattcttcagcattccccactctgagttcccactcagagtgatacccacaacatcctataaaccatgcccccattctccaagatgtggaatatatccaggcctactgggatgatactttttagcaatgatagagggaaaatatatcatttttggtatccctgggggagagttggcacattcttcagttatttgaataataattaagataatgccagcatttaacactcactgagcacttacattgtaccagaccctgaactaagagctctcagtatattgtttcatttattccttcaacactaagaagtaggtagtactattgtccccattttacaggcaagtaaactgagatacaaggattttaaacaacttttcacatggcccgtaagcggtagagtcaagatttgaactcaaatctaacttcatagttaacattctcaaccactacaccatacttcctcaatgacatttctctttagaaacacgaggaaataaatgtgggaatgaagggtatacaattatgtgtacagtaagattgcaaatactaatttagaaaagaaagaaaagaaaatcctgaggcagagaaaatgaccaaagagacaaactcatgtgaaaattttctttaatgaatacataccacttttatgattaaaaaaagagtcctctctttgtagtgaccctagaaataagtggcaggacagagggcaggaaggggctgggttgagtacccagctaatcagtggggctgtctcttgagtagttgccagtgatcagtaaaaggaacagtcatcaggcagcagctgtgacctcagtacctgcaccctcatggtacaaaggtgaagtgggtcactattcctgccatctcaccatctcccctcttcctccaggtgcttacactccagagcccctcagcagtttccggtgggctcttctctcaactggcctcatgttcttttatcacttcagcgtcttgcagatc

SEQ ID NO: 5826 - DNA, 37879 bp, human
tctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaatttttattagatactgacaaattatgcttttatatatgtgtagggtacaaggtgatgctacgctatatgtatacaatgcagaatgattgaatcaagctaattaacaaactatatttcttacaaaccactcccaaccccaccggcagctctgcatggggcacagagccttcctgtctcttgcctacagcttcctctaatggaggctgctctttctgccctgccccatatgctgcagagccccctctgtctcttctagagcactatctcatctgtacgttaggggaaaaaggctttctcttttactattctctctctttttttttcatcaccaccatcacttgacctcttggtcccttcccctatattcctagaagtcactggcctgtagctctcaatatttccattataatttgagccaacatcctgagagacttcttgtaaggaccacccatccaccccagcttctcaaggtttgggcttcttaattgcagtgacctcagcattcccttcttttcagccaccaggaccttgttttcccgtaaagctcctctatgtgagaacgtaactcctgttatgttctttctttgacccaaatctccactcctttcctcttcttcctattcagcttgtatctccatgacctatcattgaaactttcactagctcctgaaagtgtctcacctcccttgtcccttccaactgggatcagtgtcccatgccttttcagtgtgcccagtcttggcctactggaggagctctttcaagccattctgattagggccatgaaaatttcatgatgtctattataattgtgctctcaacaccattgctcaatttattttctgtctatggccagctcctccacacattgccctcacaagtcctgtgctaaatctttaccaccctcctcaaatttcctgtctactctgttcaaaccttctgttctctccaccctcaatagatcccccctctccccacaaatgactgagaaaattgaggttttgggatggaaatttcctcaacacttctctctacctctacaagcttctttacccacatccatccctatcttcctccttctcatcctggaagaaatggtgttcattctgttctggccaataatatccctgtgcgattagctcccacccctgctaccacctctggagcctcattctatcaattaatcacttatgtacctggatattctttttctttctttttttttctttttttagacagggtctcactgtatcacccaggctggagtacagtggtgcaatcacgactcattgcagcctcaacctcctggcttacatggtcctcccacctcagcctcctaagtagctgggactacaggcacatactaccacacccggctcattttttttttttttttttttttttgtattgtgtagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctcttcccttcacacctaagcatcctaaaagaataatctaaacaacattttctaaaatttagttctttgggcaagacaatttttgtcttatccacgtaaccatgtgtgttattatgtatgtaatacatgtccttaaatctattgagttttttttttttaactaaaatatatacgctttcaagagaagccccataatatccatgagattgtggctttgatttactggttatctattttaacacagtttatatacaaaactattaaaaatgaaatgtttatctgtttgccacctgaaatcacctcatacatggtgcataactttgggagacactggggtctgcccttgagttttcttctcaattaccctttattcctcagaccatttactctgatatctaaccctctaccagacttttcacagaaatggtgcttctaaagatcaccagcaacgtctgtctgaccaaatctaatgaccatctctcagtctttatcctacggaatgctgttgcattggatggtattgatcactccgttttggattgctctgcttcggggcttccaaagttcctccctttcctggctttcctacctcaccaatcatgtcttctcaagtctccttcacaggttattttttctcactcctctgagatgttgagttctgttctaggctcacatctcattctaattgtctggtatggttttgcctgctttcacggtttaactactagtctgtctagttatggctgctacatcactgtctacagctcagacttacgagagtcacattcatatagtttactcaacttctctacctaaatgtctcaagcatatgtcaaacccaacctgtctgtgtcaaactcattatcttccctgtcagccctcctgctcttcttgtggttcgtgccaagtagcagcatccaatcaccccagctaaaaactgggaatcatccctgcctcctgtatgcaatgcatccgttcatctcacatatattaacatatgccttcttcctgccaggatccagactgaccactggggtgccctgataagcaaaaatcagacaccaccctgtccttcataacatttataagctagtgggggtggagtggggagatggatatgaatcaaatatcacatgaatttatagttatgactgagataagtactctgaaagaaaggaacatgctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccatatagttccctgctacaactccacgagtaactactatttttggtttttgtatatcctcccagagtttgtttttttgcatatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaactatatgccagatattgtcacacacttttcccatgcattaactcatttaatcctataacaactctgttaggaaggtgttattattatctcccttttatggaagaggaaactggtactcaaatagcaagtgacagtccccggatttgaagccagtagtatggttccacggttcttgcttttaatcataacacaaagttacaacactatatcataatttatttttttcagtctgctattgatggacatttaggttgtttcaaatcttttgataatgtaaataacactgcactgaaggaactggtacctttgccattttgcgtgtgtgcaagaatatctataggatatattcccagaagtggtaatgctgaatcacagtatatgcatttgtatttttgttggatatttccaaatccatgaaagttgtaccagtttaaatgtttactagcaatgtatgagagtgtctgtttctacacaacctcaccaaattggatttttgcccatctgatgggttaaaaaaaaaaggtatatcagttcgattttaattttaatttcactttgagtgaagccaagtgtctttttacatatttaaaattggcatttggctgggcatggtggctcaagcctgtaatcccagcactttgggagaccgaggtgggtggatcacctgaggtcatgagttcgagaccagcctggccaacatggcgaaaccccctctctactaaaaatacaaaaattagccaagtgtggtggtgcgcatgcccgtattcccaggtactcgggaagctgaggcatgagaatcgcttgaacccaggaggtggaggttgcagtgagccgagattgtgccactgcactccagcctgtgcaacagagtgagactcagtctcaacaaaataaaataaaataaaattggcatttgatttcctcttccttgaactacatgctcctatcacatgctcattgttcaattgtgttggcctttttacaaaatttgaatcctaagagcttgttacatataaatattaacagtttaccctttatgatatgagctacagatattgtcctcagttgtgttttcttttgactttgctaatgttttattcttgccatgcaggattttaaaatttctttttcttcttcttttttttttcttttcttttcttttttttttttttgtctgagacgtagtctcactctgttgccaggctggagtgcagtggcgtgatctcagctcactgcagcctccgcctcccgggttcaagcgattctcctgcctcagcctcccaagtagctgggactataggcacgtgccaccacgcccggctaatttttgtatttttagtagagacggggtttcaccatgttggccaggatggtcttgatctcttgacctcgtgatctgcccacttcggcctcccaaagtgctgggattacaggcatgagtcaccctgcccagctgaatttttacctttctatgtaatttatcttttatggcatctgaatttagagtcatggttagaaagccctttactactccaaggttataaaaaatatatatcccatattttcttctggtatgtttatagttccttttattattattttttacatttaagtcttttattcacttggaatatatcctgatatacagtgcaagataaagatccaactttatttccagctggcttcccatttgtccccacactgtttattaaatagtccaacatgatccaatctgcttgtggagaagatcatattggctgctgtgtggagaaatcactgggtcctcctgctcttacctcctaaatatctctcagactcatcctctccttaccatctctaggaccagtaccttgggccaagccttgcacatctcttccctcaatgatgataattggctctgtgtgatctctctccagccagcctcctttgctccccctaagcccattcctggagctacttctatagctcaaataggatcatagctctttgtcatttggaagctttcagtggccccccatcttccccagtgcacaagaccgtatgacctgatacccaaccccttctccaacctcatgtctttacactcccttctttatactgtacactgtggtgatacccaaatccttggggttccctgagtattttatccaattttcatgcctctgtgcctttgaaaatgctgtgatttctgccaggaatgctcttctccagctgtgggcctagaaacattcatttgtcaaaactcatgtcagtagttactttctccaagaagccctctgtaactattctaccccagctcccgccagctgcctctgttcctcccatttttgtcatcctcacagtatagtctttacatgctggtctccctgaggacaggaatttttcatttcttcttggtatgtaggtgatgaatgaatgaatgaatgaccttctattcagggatgtattcctgtactgcaaattgcacataatttattatacatcttacaagctaatgtttactaggcactgggtttgttacatgtgtgatcttgatctcatttaattcccacagtgtccactagacttatgggagtacatcacgtgaggcccatgaccttgaatgagaaaaataatcacatctttatgtccattaactgcaactgaaatacagtcatctctcggtatccatggggaattggttctaggacttcccccaccacaaataccaaaatccaaggatgctcaagtccctaatgtaaatgacgtagtatttgcatctaacctacacacatcctcctgtatactttaaaggaagcttgtctaacctgtggcctaggatggatttgaatgtggcccaacacaaatttgtaaactttcttaaaacattatatttgaaaaaaattttttttcagctcatcagctatcagtagtgtattttatgcgtggcccaagacaattctccttcccatgtggcccagggaagccaaaaaattggacatccctgctttaaatcatctctagattactcataatacctaatacaatgtaaatgctatatacatagttgttatactgttttttatttgtatttttttttactattgttattttcatttttaaaaaatatttttgatctgtggttggtcaaatccacagatgcggaacttgcagatatggagggccgactttgtggtatatcctttagtaaggaatgtagataacaaaccacagttacattagcagcacttggcatgctgttgttaatgtaaattacacttattttcctcttatgttagagttgttgcagatatctcaaaaaatcattggcattcatcattacctcaaaatttaaaaacagatgtgccttttaaaagcattttgataactatagttcaacatgattattttcttttataatcctatatattctatttcgtatacttaaatactttattctgagagagagcctttacacttccccagactgcccaaggagtgcatagtaccaccaaggttaggagtccctttactagagtttattttatttttatttttttgagacagatactcactgtgtcaccctggctggagtgcagtgacctgatcttggctcactgcaacctctgcttctcgggttcaatcaattctcgcacctcagcctccagaatagctagaagtacagtcacatgctgccacgcccggctagtttttgcattttttgtagagatagggtttcaccatgttggccagggtggtctggaactcctggcctcaagtgatccgcctgcctctgcctcccaaagtgctgggattataggcatgagccactgtgcctggcctgcactagagtttaaactggtgtttgaaaccaggtgggcagagatgcctctatgctgcctgtccatggagtcgctggattcagacagactgtaggtacaaatcctagttatcccacttgctagttagttctggcatttggtcgagtaccttgacctctctgtgtctgttttctcacttgcaaaatgagggtagtaatagtacctacctcatagggtgttatgaggattcactgagctgatacatgaagagtatacagaacaatgactggcacatagtaaatactatgtattgggtttgtataattattaattacccactgttctgccttgtgttaattattcatctttcttccaactagactgccgtctctagaggtcaggattgtgccttgctgtgttctaaagccgcagaaccttgcatgaactgagagcatgcttgtcagtggatgtaacattactggtcctccctcctttgagacacttgtttctcctttgagctccagggtacctctttctcctggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctccttgtacttttattatactttattataatatgcagtaaccaccatttctagttgtctgtattttgccactaggtggcagtagtcacatcttttcgggagattaagataattaatattggatattgatttattttatttattaaagatgttgattaataattgttgtaattgaggtgctatgggaataaggatgcgggtaaaatccgtgaggcccctgaattttggcctgagtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagagagaaaggggagtggatgaattacaagttgatgacaactgctgagaatgacaggggtttggtggtggattgagaagggtaatgacaagagaaataagtgctgtgggaaatggaagaaggagataagcctagactctctcaacactgtccaatagaattctctgtgatgatgaatatatcctatatctgttctattccacatggtagccactagctacatttggcttttgaacagttgaaatgtgcctggggggactgaagagttggatttctcattcgattttaaggttaattaatttgaattgaaattgattggttggttgattgattgattgattgattgatgagatggagtctcatcctgccgtccaggctggagtgcaatggcgagatcttggctcactgcaacctcgacctcccgggtttaagcgattctcctgccttagcctcctgagtagctggatctacaggcacatgccaccatgcttggctaatttttatatttttagtagagatggggtttcaccatgttggccaggctggtctcaaactcctgacctcaaatgatccacccacttcagcctcccaaagtgctgggattacaggtgagagcaactttgcctgacctgaattgaaatttaaatggccatatgtggttagtggctattggacaacatagctctagaaggttggtgactggcactgtggggccctcctgaaagaagaatccgtggatttttctggcactggtttgtacggttaccccatttggggttcagcagcctaagtggaggtgcaggacatctggctggagggatccgtccaatgttgaggctttgtaagtagggtcagtattgttgaaaatctagaaagtgagggatgtttgaggggttctggagagttttggtaatcctgcaacgcactgtattgctttcaggtttctgaccaaggacaggtcacccaaggagcaatagcagaatgggagacagagcagcactttattattagctgagcaggcatccagtatctttagtgctgggcgagagcttgcagctttgttctcaacatctaggtgagcttcccactctgtacctagagaatataatgtggctagatgtgtagcacaggcccccccatactttccaccctatcaaaggcattgagaagctagagaggaaagtgaagaggcctggctatgcagagagacaggttctgctgagatgtgcacgacgaaatacacatgctgcccattacaaagctagactacctggtttcaaatactggttctcctccttactagctgtgtgactttggccaagttcccttaccttctccaagcttcagttttctcatctgtaaaataaaaataataacagtacttcctcatgtggttgtaattagcattaaatgacttaatgtattaatatataaagtgcttataacagtccctgtcatgtaatggtggtatataagttgtttgctattattagtatggtttcagcttgccaatatactgtggccctgcctactaatctaataaaatgtggtttgagcagttttttaggttctcacctttagtaagccaccctttggggatgatctagtgaggggatagatagaagtgtggggagagggggatgaagagttctgcttcccaccagggagttgagagtgctggtgtcagagttcgaggccatggggtccaagctggtgtggaagaaaggctagaagagagctggggaacaaggaggaattctatggagggaggtaaggagcatcaagggatcacaggtcacgaggaggtctaggggcatgcgcatagtaggaataaggatatgaaagctgaactgtcgggaggttgtggtcagatgatcccagcagaggcggggcagttcaaagtgatgacagaaggcaggttgtggttagtgcggtggagtagacctgtagagttgaggaggttcaggaggccacgaggttagggtattggaagaggtgcctgcatggatgttaaaatcacccagaatgccatcaggaaaaggtataaaagaaggtggtaagctaagtgacactgatctgaggtgaattcaatgacctggaggccaacaacaggtgacagtgacaaagaggaggaactgaatcttgaaagagaacgagggaagagtaaacgtctagaagcaataatggagggctagaggaatcttcaacttcccttcccccacaaaaaattgctgcaggaatagaaggattaaaaaagaacagccttctcagagctgttagtggaagaaatcacaccctcagtggacagccagggttccttagggtgaggaggtgaaagggacattctggggaaaggtggcaggtatagacagattggttgatcataaacaccccaggccagtggtggtggtgggcttccagaggttctagtgggatgggttgggaggaagtcagccacaaggtggttggaggaaagtgcccacacagctttaggcccacagcttggtcctgcctacagctggtgacacaactcaggagttcccctctcttcatccttgtgatgtgtttcgattggttggttgtgtttgttttcatttcggcagcagttcttaacctggggttcacaaataggatcttaaggggttcattcacttgaatggggggaagtcacatctttattttcactgacctctagcagaaatgtagcacatgaacgcagacaacaagcaccagtggtattagccctacctgtgtctttgttgtcagtagcaatcacagatggcttcctatcacatttcagtagtagcggccatctcaggatagtgtttatgctcatctgctttgaaagtgatggtagttattaggcctgctgctagatcttgtgattaaatgtatttataaagaaacataattagtatattacaaaattttaaaaatattttggtaactgtgttttaatataattgaattcctttggcttttattttatgcatttcaaacactgttctgagaaggagtcctttggtctccccaggctgctggggtgcagggggtggggtggagggcctgcttcaagtctgctgggaaatccctttctatttcactagagggagctcttgtttcagaattgctgagcagtgaccctcaggcttgacacccagtaataaggttgtttttttgttttgttttgtttttttgttttgagacagagtcttgctccgtcacccaggctggaatgtagtggtgtgatcttggctcactgcaacctccacctcctgggttcaagggattctcatgcctcagcctcctgaatagctaggattacaggcatgcgtcaccatgcccagctaattgttgtaattttaggagaggtggggtttcactgtgttgccaaggctggccttgaatcccgaagtgctgggattacaggcgtgagccaccgtgcctgcctgagaaggctgttttgaaatacaggcaattcagatgtttttggaggacatttcaagaaactggggttaagaacctcagtgttgtttgttctaggcaggccacctctctcttgagtgggctttcagctcatcttctggaggatgaggattggacctcctgtgctagttactttctgggaccagttaaagcggaagtactttggccaatggcagctcaaaaactggccccaaggtcatgctgacatcagtatccaggctgagtttcctgtttctcctccataccattgagcccattgcccctcccatctagctagtgttaggatgttagagaagttcccctcttccatgaggcttccctgctccactatactggtcaggtaagggcaggtgaaagtataggaactctggtaaatcctgaggctcctaaagggttagtggatgaggggggacctgagggatttgactgattggcgaagggctgagccttgtgcaacaggtgggtaggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatgaggggaaacctgacttgagcctacactcagtggctaagaatggggaatcaaatattcacgatcatcttggggttgtgccatgctgagatatcttttaggcagccacagcttacaaaggctaaaaatggaggtatctcatttaaagagtaccaaagatgggaatacattgttgtcaggaaccaaacttgtcattctcttccctatccccaaacctgtaccttctctgatgttccccatccttttcagtgataccatcacctatttgttatccaggccaaaaatctaaagccaatcattggtctatattcctatccctgcccccatccaatcagtgaccacatcctattaatttgaccttctgatcatttctcaaatttatttccactactccaactttagttcaggtcagatcatccctgacttcgtttattgcaacagccacctaactggtttcccagcctctagcctcaccctgttttgtcctcagggcacataggatgaggcctgagaattggccattggatttagcaatgaaaaagtcatttgtgaccttaatgggagctgttttgatggagggagggaagcctgataagagtgagtttaagagagaacagtaagagagaggaattctaggtagggagtataccagtgctgtccaataaaaacatgtgaggcacatatgtaatttcaaatgttccagtagtcgcattaaaagcaggtaagagaaacaggtgacattaattttaataatagatcttacttaacccagtatatccagtattttatcattccaatataatcaatataaaaattattaccaggatattttcctggatttcctttgaaatccagtgcacattttataataacagcacatctcaagttcaaactaaccacatttcaagtgcccaccagctgcatgtgactagtaactaccacattggacagcactggcatagacaattatttcaaggaatttagctataaaggggagcagaggagtgaggtagtggccagatggggaagtgaggtcaagtgttgacttgttggttttagaacgggagctattaaagtactttccgtttatacactaatggacttaatccagtagagaggaagaaattgttgacataagatgacgaaacagtgactggagtgatgctgttgagtaggggagaggggatggaatctggatgcaagtggaaatgctggccttggctaggacacagggcagttcatctgtggtgacagggagcaggggagtgaaggaagaccatactgggcactgatgcagatagatgggtaaatgtgattgtggaagcttatggaagtttttgtctgattctttttttcctctgtgaagtgggaagcaaggttaatatctgagagtgaaaatgggatagaagtattaaagattcgagaagagagaaaatattaatttgtggcctaggagcgtgacagagtgaatggactggggaaatacagtatgattgcctggcaacatgaaagatgcacttgaggtttgtgatcacgaatttgaagtgagaacagtcagcgctgttgtttttctctagtacattcagctgtgagggacaagcaaggcagaggaggagctttggattcaaccagggctgggttttttttccagctgagtatcattccataatgagaagaacaatggagtcaaaggcgtatgcaagggataattagaatcatgggccatggaatttaaggacagaaaagggagccatgagggacagtaaaaagatggtaggaccaatggatcacagattccagtggggtcaaagaagtattggggtcatggttatcgggagtgagctggaaaggtagaagtggtggttgaagtgggaatgcttgacttggagattagggaggggctacagatatacataattataaggtctcaggcacgaccatgataatgagtggctgagatgtggtagagagcagggtcattgagaacaagaggccgaggaactgacagaccaggatgctggaaggttcatctagatgcatgttgaaattaacaagaaatctgatgagtggtagtgagccaggtactaaaggaatgagggccatgacccatatgtctgtagatgactgtgaaagggaaggatagcgggtggtacagtatggtagtggtaggattttagtgagaagggagggccactcgtctaggactacaatgaaaagaaagaagttattcactctacctacatgggccaaaggagaaaaatcagtcactactttagagggccacagatgaagcaggcaaggagaggtaggttgggtaacaacaaaagggtgaagggaacattcagagaagagattgagaacataggaattgagctaatgatttatctgtgattgttgcctatcctgttcccttttcctggaatttccttccttaccttgtacacatagagaactcttcatctttcctcatccagctcttgcattgctactttcctgaaacggctattgcaaagattactaactagtgatcggcatgttgccaaacccagtggaagtgcttgcctttactgtacccctatagagaagtgtgttcccagtggaattttctgtggtgatgggaatactctatctctgcactgtccaatatggtggccaccaggcacatgtgactgctgagtatatgaaatgtggctgatgtgactgaggaaccaaagttttaattctgcttaattttaattcatttaaatgtaattagccacatgtggcaagtggctaccttatttattggttggtgcaagtaatagagcacttaacattattgatcctttccttcttgaaacttgatgttcttttgacttccagcacacctctctcctagctttacgattgcctctttaattttgtcttcattcttgacttctcatggatctttctccttctgctagccacttaactgttgctattttccaggcttcctccttcagccttttatcacattttgtggactctttctcattgatcttatccataccccaagtcctgtttccaggccatctccctctcctgagcactagacctggacataacagcctattggagacatctgctggtgtagtggataggcattcagtgctggcatgctccaacctgagctcatctcttctctaaattacctcctctcagttactgaagccatagacctggaagttagtctagatgtctccttcctgtctgacaaattgccaagtcctctatgccactgcagtaccatttgaacttgtcatcagtcttgtccctctccagtccattgtccacattgctgctagagcagtctaggtagctgaaacataaatttgacctttttattctccttgttaaaaccttttagtggcttctcattgtatataagataaaggccaagttcccagcatggcaaacaaggctcttcatgacccagcctcacctgcatgtttttccagcttcatctcctgacatgtgtcccttctcacaaagttctctcctttccagtaacgcagaactccttctaattgcacacaaacagcatgctgtttcatgtctccacagcttttctcaggctataacctctccttccttcaaggccctaccctaaccccttctggttctgcaaagctcacctcaactgtcatcttctccagctacttttcctcagtgtccctgttacttaatgcacttacctaactacaccattgcattattcacttgtaaacgcaggtagttcccaagagtggggaccaccatctttgcctccttctttccactgtctggcatggagtcttactcccaatgtggactctgtagatgttgagtgaatgggtaccatgaataagtgagtgagttgaaggaagcaggaagaagattagagagtgggatgtcacactgcccagtctcatctccttagtataagtccttcatgggtgggattataggatgagaaaaggggcccctgggaggcctgtggggatcagtcttggctgctgctggtgcaactgacttctttcccaggactcataaaacttgcttctggcagaaattgattttagaaaaagctattatctaggttttcccctacctttacagctgacatgcttctctcttcctgggatataagatgctagcaaaaaatgtcacattttttcttaaaggagaaaaaggttttgtatgtttaattttttgaaagtgcttaagtttctgttttcttttagaagaaaactggtttttcactgggattttcccaagggccacatgcaggtatacagaaaagagaatgatatgtgtttgcatacaatttgcatatatctgtgtagactggatcatctattctcagagtactttctttttttattttttcaaaaaaattgaatacttgatcaacttttcaatgaaaagaatcagtaacagtgaaaggcaatggaagccatagtggaagtcctccttcatagagaagatcacctctttagaagatgccccatcatcttctagtcttttataagattttggatggttgtggtcgccatgataaaaaatagcagcagccatctgcatgccaggatagctgtcgtatatacttttatctctctttttccactcaccagcccttagaggtagatgttaccctcagcccaccagcaggaaaacaggcttagaggggcagcacaatttgcccaaggtcactcctatgggtagtggcagagccatgattcaaacccaaggctacatggccccaaggcctttgtttttaaactactaagctgtattttctgccatttgtgtactgcctggtgttttgtcttttgtccttgccattaccagccatagacagatacatagtttggctgtcatttgaatggtagtggactctgttgcacaatgttgaggtaccatagtttatgtaactatctccccacttggtttgtttccagtttctcagtattatagatagtgcaggtgtaaatatctttgcgcaaattagggtggtttgttggagtttttaggtatttgatggtggtccgcaaagtagtatttttgaggcaaagagttataattttatgattctccagaaagtctataccattcattcacccaagcagtgattacttttggagtgcccactgtgtaccaggtgctggacgtgaagaggtaattcagaaacagcccctctctcagagaactaacagtctggtatgggatggatgatgcagcacagaatgaatgctactaaagtcggggtttgggcaaggggcagtgagagcactgagaaacagtgtcccctggtagtatctctgagtgttcctttccctctgcagcatggggcaagacgggaggagcatgataacagggctggctgcagagctgcctcctggctgaggacaccccccaccaacacccacgggctttcctgccaccgcctgttggctcagtcactgctgcccatctgccactagggggcgccgagcagagaggatggagggagggggcacccgggacaacaggactgggggctccagcagtgggaggagtggcagcctaagcccttgtctgtcctccaggcctcctcttcccctgtatgcccaccgcagccagggtgacaacacggtgcccagtccacactcattcagcagacaggaatgtgtgcatgccttaagggcatagctctgtgcattttcacgcaccaagcactgtgctagatgctaggaatgcagaagtggcctgacatggtccttgaccctgagatgcacttggtctagagggttggacagacaagggaagagacaatccaacttgtgtgctggaggccttcacaagtggcaacaggagcgttgagctccctagtgagtcccctggcagtgcgtgagagttcatttctccagtgctccgctcttatgactttggctgtgacattgcccatcttctagcctggaatttctccatctataaaatggagggaatgatatctatgtctgcaagggccttctgactcagatgtgccatgagcctaaagcaagcctgagcttcttccacagaagagcccccagccctggtccccactttagtcactgaagaaagtctcctttctcttctcgcccacatgctctccttacatggttttccttggcattctgcctctggccttttccttctctctttctacgtatgttcccatgacttcagttaccactgtgtgctgatgacacctacatctccatgctcgcccccatcctctccactgagtttgtgactcatataacaatgaaaataatcagcatttgctaaatcccagatacaatactgtaattacggtatattatctcatctcatctctccaacaacattgtgaattaggcagtgccaccccattttataggtgagtagaaccgagttcaagagatgctgagactttcccaaggccccaaagttgataagtgatggggccaggatttgcaaacctctacctgttgagctccactgcccatgctcttatccatcacactatatgtcctagagtacaggcagccgccaaagacccatttccacttggatattccacatacacctcaatttcatgtctaaacttggcctcatcatttcccttctgtcccaatctgccttttcctctcttctccatggcaataaatggcaccatcaacccagtgataccccagccagaacactgggagttttccaagatccttcctctcccttaccaacccccatctccccaacaatcttctccaatcttcttccacatcatggtgattttccccccactctcctccagcctcactgctgttgccttccaaggccattcatcctgttctctttttgggctcctgtagcaatcttcttaccagcctccctgcctcgactctgtctgcttgagtccatcccctgcacaccagccagggtgatcctttgcagacacacgtgatcacctcaccttactgcttcaaaacttctgctttctgtgactctacagcagagctcaaagctggccacccatgggctgaaatccattcagaagacatgttttgcttggtccaaaatgttcttaaaacattttgaattagtcgccaacattggaaaatcaggaaatttcacataaaagttcatatatattggcttctcttgcaaaagtgaaaagaactggtaactctgggtgcacatcccttcagggcaatgattggatggagctgagtggtggttgccctctttagaaggggtgtgggcttttcagtttgacagtctccagcatcccctagtgtctcttaggccctggtcgcacccctgcttccaattatctgcctgagagttggggcatttgagttcatgaccctggtgcatgggatgaagcccaaagccctcagcatggcttctagtgtcctatgtgtcgcagcctggagcagaccagccctgcgaacctctgaggctagtacctgctaactgccccgttacactctcccctgtggccccatggaacccttatccatagttctctgaattgccccactcttgtctgtctccatgcaagcttgtgctttggaattcctaggcccctccttaagtcctatttgtccttctgggctttgcaccagtacttgctgtaccaagaagcattccttgtgcccctggctgagttttgttttcccataacaggtggcgcagacctcagtcatcccaccagctaccctgtgttgtagttgttgactgtgagtctgcagttgcagggaacctgccttctttatcttcctgtcctcaaagctttgcacaggacttggaatacacaaggtgcctcataactgttgaatgaatggatgaatcagtgaaagactgatttgggaaaataatagtctaggatatgatgtcaaccctaattgcttggggtgggggttccaggtccctttcattcttcagcattccccactctgagttcccactcagagtgatacccacaacatcctataaaccatgcccccattctccaagatgtggaatatatccaggcctactgggatgatactttttagcaatgatagagggaaaatatatcatttttggtatccctgggggagagttggcacattcttcagttatttgaataataattaagataatgccagcatttaacactcactgagcacttacattgtaccagaccctgaactaagagctctcagtatattgtttcatttattccttcaacactaagaagtaggtagtactattgtccccattttacaggcaagtaaactgagatacaaggattttaaacaacttttcacatggcccgtaagcggtagagtcaagatttgaactcaaatctaacttcatagttaacattctcaaccactacaccatacttcctcaatgacatttctctttagaaacacgaggaaataaatgtgggaatgaagggtatacaattatgtgtacagtaagattgcaaatactaatttagaaaagaaagaaaagaaaatcctgaggcagagaaaatgaccaaagagacaaactcatgtgaaaattttctttaatgaatacataccacttttatgattaaaaaaagagtcctctctttgtagtgaccctagaaataagtggcaggacagagggcaggaaggggctgggttgagtacccagctaatcagtggggctgtctcttgagtagttgccagtgatcagtaaaaggaacagtcatcaggcagcagctgtgacctcagtacctgcaccctcatggtacaaaggtgaagtgggtcactattcctgccatctcaccatctcccctcttcctccaggtgcttacactccagagcccctcagcagtttccggtgggctcttctctcaactggcctcatgttcttttatcacttcagcgtcttgcagatcctcggcctggtaagtttggttatatccccttctatcccctctgtttgcagttctccataaatcttggtaatcctggttggtgctgacgtatcactttgttttgaaaatgcaagatgctaaaggccaggatgtcagattgttgtgtctggattgctgatttatgatctacagccttggcctctccaaagagttttctgagtctttcagtaatgactgtttctttcatccctggggaggcaaggatgcctttcactcatggccacttgggtcggaaacaatgagctgcaactggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatggttggatggttggactcagtagctgagttatccagagcccaaaattgctgagtgtaagagtgtatatcagtggcaaaatgagtaggaagagctcaggactggggctgggggtcaggagacccaagttcaagtcctggctctgccactgctctgaatgagtcacctcacccttgagggcagagagttctccacctctctttgacatggtataaaagccccaacttccctgagaggtggtgaggacttgtctttaatgtgaacaggcttgaagggctttggaaggcaggtgccgcgaccgtccccggggcaggtgtcgcatgtctggttttgtgtgcaagtggcagtaatgtagcattagccatgtggagcctcgcgtgacctagcatgactagggcgtgtaactgatgtccccaacacctttgtagaagcagtcactttctcttcctcattctggtgtatggctctgctctggtttgctgggggcttagtctgagctccttgccaacagtgtgaatgcttcctgcgctctcaggaggaagccgtacaaagttcacacccttaccacttgctgctctccactgggacccagattccagaggcatcagtgtgctcatgtcaccctacataccatgctcaggcaacgcctcctacaaggagggcaaccctcaccccattcctcaccataaacccccatccatctttcatgagtccattcaggtaccacttctgtcatgaaatcttctctgaggactcagcccccatattgtatgctcctcagacctcctcatagtgtataaagctgggtgagccctgtctggtttggggtcagatgtagtaaacctttgaccacccccacttgattgattgcagttacgtggaggcagggcccacgctgtgggctgtacttttagcctgtaacacctctccggggtctaggcacatagtagatgctcaggaatggcaacaagttctgggcccaaacagaaggcaagaccgtgagcaaaactgaatagcttttccactagacggccctccgccatcacctccagaggcctctagcttgactcactcagaaaaccgaggggagagaagaaatccctttataaacaggtggggattggtcaatccctccttgtctagtcccccattaggtagagatggctgaactggcagaagccagagaaagcctaaggatggtgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaacccaggagtcctggccttgcttcccagaaccctctcagaaggccctctgctttgaaaaatagacaaaaggggcctctggccctccgtactgtggaagaccctcaaaggacagctgggctttctcagcacacttttgtcctgggagctgcgtggctggttgcccttgaattcccacacattgcctacttctgccagggacccagcaggccatttgctcttagcagagggcttgtctgccgggcacgtttgctgggctctctggtacccaaagtgcattgggctaggctggaggactgagctggagaaggcaaacacattcaggcccactcaacctagatttcctgagggccagctctgcaccagcacttctcagcacaggcctgcacccagcatgggtcggaccatgaacaagatagccttaccctttggaagcagacctgcttttccaaggctacctgctgagcagcccatgatgactgtgattggccctttttacacaggacagaggccctgttcaggctttcacctgggctgctgtttctggagaggagaggtagccagatagggaggggtagcagaactgaaaggcacaggaagaaagggggccagatatggcgaaggggaaggacggaaagaggctggtggggaggaggtgaggagagttggttcgtgtccttcccccatgtgttctttttcaggaagagagctgaaaaagacaatgacctaggccattgccatccctaccctgggcagtctttgtacagctagccagacctggcagccagtgcaggtggatctcctcatttgccagtgtttgggcacccaggctatgaatgaggcagggtcttgcaattgtggactagaagattagcagcctagaaaagtcacttatcttgctgcctcaggttcttaatcagcaaagtagtagctccaactgcacaccaggcatggagccaaatccctcccattacctcttagaatccccatcaaagtacaattagctgactggcaatgctgtccttgtacggtagggagaaagtgagaacatggaggtttagtcataaatggaggagctggaattggaaactagttttgttagaccccaaagctcacatgctctccactctccaccagcttccactgcctttccagtgtgctggcactgctgggtagacccttgcccagggacccctggtccttatagaagtggaaagagagccgggcagtggtgtggaagatgagagagaaaggggaggcccacgagtgtagaaagcagaggaatcaaggcctgtcagcagcagcctcaaagcagacctgaaaggcacaggaagaaagggggccaggtgaaggggaaggatggaaagaggctgcggagaggaggtgaggagagttggtttgtgtcctttccccatgggttcctttttaggaagagagctaagaaagacgatgacataggccattgccatccctaccctgggcagtgcatctgcccctaccaccatgtccatccccaccctagtctgtattccctcctgcaggcaacagtcttttccagtgcagatctgcatcacttccctgggccactggctctagaatataaagcccaggctctttcatgtagcatacaagccctgggctttgtaagcatcttcaactacatctcctccaccccacactcccaaaagaagcatgcagagaaacacttcactccagcgggatcgtactcccctttggcatgccacgccatttcccaggtccttgccatttgtttcctttgtgctgttttctcagcttcccactctcccgtttcatcctaaggcctccactcaaaggttagctcctctctgcagtcttccctgagccccaggctatgttaggtgccagtccactttgctcctacagcacctggtactaactctggccatcatttgcctccctcttacgtgattcattactggtctctctccctctgtagacattaagctccttgagggccaggtggggtctgattcatcctccagcccctggcacaggacccattccatggaaagtgctccgtgaacaaggatcttacacctgagtgctaaaatatggtaggaggcaccactgttctctgatggagaaccctaggctacataagccatgcccatcctatgaattctcctggatggggctgggatgcctttgtttgcccaggcacctcaagcttcttgctgaggggccccatcctgtttctctgcagggctctatatagttggtgtcctggataaggaggcagtattgtgagggaaaagcactaagaccaacagcaactgttcacctgactctttcctggacctctgggcaaggtgtccaactgcttttccatatcctttatagctcttcatcaccaccagggtcaccccttccttccctggaggcacacagagttggtgtctgcatggcaaaagccccaccagcccatggaatgtgtcatccaccccgctgaggggtagggagcagcttgagatggttacaacctgatcccccaatgagcttttcccttgtcctggtttgccagtgccagtggaggaacagaaatacacagatgtcagcctgacaaatgcaatggtttaatcaaaggatgtgtggtttgctaaccttggcaacaggcaaggccaatgtagtctaaagtcaaggactctgttactgcctgaacccccccgccccgcccacagtcagcactctgcctcgcatctgaattgcacacctgggatgtctgagctgctgggcaaaggggtttaagagccagggaggcagtagggagaggcttctcctgtggctaatggatgccctccacagctgacttcctaactttcaataactcctgcatcccagccagccggtaatctctgcatttcacactgaggcaggtctttgcagtgggggtggatgcttccttgacacatctgtgctaggaaacagggccagtagcatgagtcacagagctgttctcctgtccaacaacctattctcagccccatcactgctccagccagcaggcctctctgctcccttccacacttcccttctccatccaaggggcttgcccaggtgatgccaacctgccactgttgtcccttctctatactcaggaggctcatgctttttagtattgcatttttagaaagaccttgggctctctagtattctgtcccctgagaacagagggatcttcctgtgcattccaagacatacactcagatttctagcgtgtcggcgctaacaagatacctctagtacagtggactgtcgattttgttgctcattaatcccctggggagctttaaaaatctcagtccccaggcctcacccaagctcataattcaaagcaaacttcttttgctttcaagtttccaggccggttctgagtcatctctttgacctgaccgtctatagcagtgcctttttaaaaaaggaaatatttaagatataccaaaaggtatcaagaataatacctaaattcagcttaaaaaagaacattaccaatacagttgaagcccccttgctccagaggtgtacagattcttcctcagcacctcagggttgctggagaggtgcctcagaagccacctcaggcagcgggggatgcatcggagtagagtgggtggtgctctggccttttccctggcttcacccagaacaactccaattttattctgttttgtatattgaggttttggaaataactttgttgggaaaaggagttaaaagttacttatttacaacctcagtagttatgtctctatcctttccctaaataatagttgttgtcctgtagtagtcaaaccagcattgtagcaggactgagcaggcagggcctgctctcccagttcttccctttcaggtcccgagtgcccttggcaaagtcatacctttcctgaactccatttgtaaaatagtagtaaatatccttgtctagcttaccccacaggacatctatgaggaatccagtgagaccagtgggtgtgagagggctctataaagttctgtccagtggaaggggttcctatttccagacagtttggttactatgcttgttcccagagcacagaggttagctggggttttgactgcactcatacccactctgccttaatgtgccctgtgtggttgcggtctgtggtgtgtatgtgagtgggtgtttgtgtgtaggacaggtgatacctcagtttatttcatggactctaagacacatttttttcacattttaacatcactaaaattggaatgcatcttaaaatcagtggcatgacagtttaatcagcacctttttttttcagcagtatataaaataacagacatcttataatctaaggcatattagagtcaatgaaatactgtaattgttaacttagactcctcttcctcttctcccatgaaagtcatcttcttgctagagaaaacccttttggaaaaatatacagacttttagcatacagcctcattctaacactcctctttttcttccctgccagcatccacccaggccaggcaaggcttctgcttcttgaccagaaggggacccactttgttgagctctctcttgggacagatggtttgtgggacatgagagggaagaggcagagtatacctgcataagggagcccaccgtgccaaatgacagggaaggagtcagacaagctaggccagccagccccaatagctctggtttctttctttccccaacagcagcctggccagacaactcagcctgcttccctggggaactcctagggctagtcattgccagaggtgaggtgagctggcagaagtaggggtgggggtgtgaagcccaatgtgtcctgaactccctgggttgatgtgagtggctgtctggcccatgcagaagaacacaatgatttccctacctcctccaacaaggtggaagaagagtcaggtagtaa

SEQ ID NO: 5827 - DNA, 243823 bp, human; identical to SEQ ID NO: 3620

SEQ ID NO: 5828 - DNA, 243823 bp, human; identical to SEQ ID NO: 3620

SEQ ID NO: 5829 - DNA, 92065 bp, human; identical to SEQ ID NO: 3618

SEQ ID NO: 5830 - DNA, 92065 bp, human; identical to SEQ ID NO: 3618

SEQ ID NO: 5831 - DNA, 92065 bp, human; identical to SEQ ID NO: 3618

SEQ ID NO: 5832 - DNA, 37277 bp, human; identical to SEQ ID NO: 3619

SEQ ID NO: 5833 - DNA, 4948 bp, human
gattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggaggtaatgagggggaaatccgctgaaggtttttgagcagagaaatgaggaggtcacgacagggaatacatcctgcttccttgagtagaattgggaagaggcaagggggaggcatggagctcctagaccattaaaccccagcagtttcatcaagtgagcatggctctgcagttattttgggtatattaactactttgaggagcaatgtcctgcccaagttactgagaacgtgggatagttgaagtactaattcttctcattatgagggaactggatgggctcagttccaattctccccttgttccaagtccaattctaataaatgggtcttttgggagctggggcccatctacagcaacatgtgttgtggagtcaggtcactagggaattagaatagcctactccttggtcacactgtatgcaagtgagataaattagcaaagtgtcttgatctgctaagtcacagaacttatccaggcagaacacccgttgccatagtaagtgtggctcttacctctgttgtctttttctcactcccagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctg

SEQ ID NO: 5834 - DNA, 5761 bp, human
gattttcttgcctcctgggctccctccacactatcctgtggctgtggcagatatgtcaatacccttacattcactgcgattcaacaatacaatgagggaggaaaatgttgagccccaaaacaagcagatggccttctgtagaccaatgacagagaccagagcagacgtacagattctgcattctcatgtacagttgcctatagtctcaacttcagcctcagaccctggagggacatccacacagttgatgacatctccagtctttgacaccatgtctgcacctctaatgggagtaccaaactctggagcattgtccccacccctaatgccagcctcagactctggggcactttccccattgctaatgccagcctcagactctggggcactgtccccattgctaatgccagccttagattctggaacattgtccccattgctgtccacttcagagtatggggtaatgtccccagggatgatgacaattcctgattttggaacgatgtccgcaacgctaatggtagcaccagattctgcagagatatcaccattggcaatgccagctccatcctctggagtggtgtgtacacctataatgagcacttcatcctctgaggcaatgtccacaccattaatgctagccccagattctggagagttatccccaattctaatgcaagatatgaatcctggagtgatgtctacacagccagtgccagctcccagctctgaggcaatgtccccattgcaaattacagatgaagacaccgaagcaatgtccaaagtgctaatgactgctctagcctctggagagatatcttcgctgctaatgtcaggcacggactctgaagcaatatcctcactgataatgtcagctgtagcttctggaggtacatcaccccagccaacaagcacccaaaactctgggggaatacctaccccgctcatgtcagatctagactctggaataatgtcatcgcttttaatgtcatctccaggctctgaagtaatgtccacaccgctactgtcagtcccagatgctggagaaatgtccacattaccaaagccagctccagatgctgaagcaatgtccccagcactaatgacggccctaccctctggagtgatgcccacccaaacgatgccagccccaggctctggggcgatgtccccatggtcaacacaaaatgtagactctgaaatgatgtctaatccgccagtgagagcaacagcctctggggtgatgtctgcaccaccagtaagagctttagattctggagcaatgtccacaccgctaatgggagccccagcctctggaaatatgtctacattgcaaaagacagttccagcctctggagccatgaccacctcactgatgacagtcccaagctctggagtgatgtccacagagcaaatgtcagccacagcctctagagtaatgtccgcacagttaacaatggccaaaacttctggagcaatgcccacaggctctatgaaagccgtggcaaaacaatacaagagagccacagcctctggaaagatgtccacgccactgaggagagctccaacttctggagcaatgtccacccaaccagttacggcaacagcctctgaaacaatgtccatgccacaattgacagtcccagcctctggatcaatgtccatgctgcaaatgagagcccctgtctctgaagcaatgtccatgccacaaatgagaaccatggcctcaggattgacatctgcagcacagatgaaagccatgacttctggagcaatgtccaccccactaatgacagcccaaacctctggatcaacatccacgctgttaatgagagacacagcctcaggagtgatgtcctgtccacaaatgagatctctggcctctggagcattgtccaagccactaatgacacccaaagcctcaggaacgatgttcacggagaaaatgacaaccacagcttctgaagcaatgcccacactgctaatgagagacacagtttctggagctctgtccatgccgcaaatgacagacacagcctctggagggttgtctgcatcgctaatgagagacacagcttctggagcaatgtccacatcacaaatgacagccacagtctctggagggatgtccatgccactaatgagagctcaagacccaggagtaatgcctgcctcactaatgagagccaaagtgtctggaaagatgctcagtcagccaatgagcacccaagatcctggagggatgtccatgtcgcccatgaagtccatgaccgctggagggatgcagatgaattccccaacctctgatgtgatgtccacaccaacagtgagagcctggacctctgaaacaatgtccacaccactaatgagaacctcagaccctggagagaggccctcactgctcacaagagcttcatcctctggagagatgtccctaccactaatgagagctccagcttctggagagatagccacgcctctgagatccccagcttatggagccatgtctgctccacaaatgacagccacagcctctggaatgatgtcatccatgccacaagtgaaggctcccatctctggagcaatgtccatgccactaacaagatccacagcctctggagggatgtccatgccactgatgagagccccagactctagagtgacatccacatcacaaatgatgcccacagcttctggagacatgtgcacactaccagtgcgagccccagcctctggaggggtgtcctcaccactagtaagagctccagcctctggaactatgtccacaccactaaggagaccctcagcctgtgagactgtgtccacagagttaatgagagcttcagcctctggacatatgtccactgcacaaacaacagccatggtctctggagggatgtccaagccattaatgagagccccggcctctggaacaatgcccatgcctttaatgtcagccatggcttctggagagatgtctatgccgctaatggaaaccatggcctctggagcaacgtccacattgcaaaccagtgttgcgaactctagatctatgtccttgtcacaaacaacatataccgtgtctggaaggatggccacagcgccaattagagcctctgcttctggagcaaggtccacatcatttatgagagcctcagtttctggatcgatgcccatgccactaccaagagccacagcctctggatgtggcatgggtatgtccatgccacaaatgacagccacagactctagagggatgtccacaccactaatgagggcctcaggccctggaacaatgtccacaccacagacagcctttggagtgatgtccactccggaaatcaaagccacagactctggagaggcatccacctctcacattaacatcacagcctctggatcaaagcccacatcgcacatgactgccacaactcctgaaactgcgaaaccaccaccaaaggaagtgccatccttcggaatgttgaccccagcactctgctacctcttagaagagcaggaagcagcccggggctcatgctctgtggaggaagagatggagattgatgaggagaagcaaatgaaggggtttttggacgattcagagagaatggcatttctggtatctcttcatctgggagcagcagagaggtggttcatcttgcaaatggaggtaggagaacctctctcacatgaaaataaatctttcctgagaagatcccagggcatatatgactccctatctgagatagacatcctcagtgctgttctttgccatcccaaacagggccaaaagtcagtcaggcagtatgccactgacttcctgctgctggcccgacatttgtcttggtctgatgccattctacggaccaggtttctggaaggactctcagaagctgttaccaccaaaatgggtcggatcttcctgaaggtggctggcagcctaaaggagctgatagacaggtctctgtacaccgagtgccagctggctgaagagaaggattccccaggcaactcaagccaggttctgccaacagcctgtaagcggaataatgaggaggccatggggaatgaactgagctctcagcagcagactgaggaggtaatgagggggaaatccgctgaaggtttttgagcagagaaatgaggaggtcacgacagggaatacatcctgcttccttgagtagaattgggaagaggcaagggggaggcatggagctcctagaccattaaaccccagcagtttcatcaagtgagcatggctctgcagttattttgggtatattaactactttgaggagcaatgtcctgcccaagttactgagaacgtgggatagttgaagtactaattcttctcattatgagggaactggatgggctcagttccaattctccccttgttccaagtccaattctaataaatgggtcttttgggagctggggcccatctacagcaacatgtgttgtggagtcaggtcactagggaattagaatagcctactccttggtcacactgtatgcaagtgagataaattagcaaagtgtcttgatctgctaagtcacagaacttatccaggcagaacacccgttgccatagtaagtgtggctcttacctctgttgtctttttctcactcccagcaccagcatgtttccaaacgctgttactacctgaaagagcatggagacccccaagaaggtcttcatgatcaccttggacagagcacaggccatcatcagaaggcccataccaacaagtaaaactccatggaatcttctcctgtgatatctgactcgaccgctaactggaggactggttcctggacccattccattaaactacattataaaccttgttgccttcacccttcagcctcccgctccaggcacatcccaccttacctctcacttggctgatttgaccttctctttcacccacatgcctaagacctgccctgacaatcagagtagggactacaagagtgtatggtgtatgaggttctgaactcccatcaccaccgaggccagtcctagttcttggtccagggagaagtctaggcaggataaatcatatcttacctcaaaaaacccttagcgtatcttgccatgtgtcagcaggcaaacttgaggaagccctggttctatttcacctggcaggggagcctataaggagagcgatgcccactcctataccacccttgtaacccagtagacttgccccatatgccccaactcatagcacctaaaatgggtctccagggtccttgccctgtttatagtatccatcctgaaccattcgttttgacccataataatagtgatagtataatggctaccagttattgataatgtatcatgtgacaggcattgggctaaactcttgacaagcaccatctcactacattcttacagtaacacaacttgttcttgtgttgtcagcttctgacctcttgatctgttgtttatggcctttgtcttgtccctcagtgggggttctctagctctgacctctgggtgaccccctcagttgttgattgctctcactccccttggctgttgtgcttcatggccagcactcttgatgagggtcttggtctataaacaggcatagatagctagaacataatgtgagcagtgtttgccttcaggtggtggggttatgggtagtttttattttcttccttctacttctctatacatttcagattctctacagtaagcatgtgttacatttgtaattataaaagtaagtaaacttcatttatg

SEQ ID NO: 5835 - DNA, 121909 bp, human; identical to SEQ ID NO: 3633

SEQ ID NO: 5836 - DNA, 121984 bp, human; identical to SEQ ID NO: 3630

SEQ ID NO: 5837 - DNA, 122194 bp, human; identical to SEQ ID NO: 3632

SEQ ID NO: 5838 - DNA, 120520 bp, human; identical to SEQ ID NO: 3631

SEQ ID NO: 5839 - DNA, 120035 bp, human; identical to SEQ ID NO: 3635

SEQ ID NO: 5840 - DNA, 119878 bp, human; identical to SEQ ID NO: 3634

SEQ ID NO: 5841 - DNA, 119762 bp, human; identical to SEQ ID NO: 3636

SEQ ID NO: 5842 - DNA, 47482 bp, human
gagtggcctagcctccctcccagcctacatctttctcccatgctggatacttcctgccttcaaacatcagactccaagttcttcagttttgggactcggactggctctccttgctcctcagcttgcagacatcctattgtgggaccttgtgattgtgtaagttaatacttaataaactcccctatatatatatatatataggttaggttttggcaacttcttaagaacataaacatccacaaagtggagattataagtgggttttataacttgaaacttttcatctttgttcaaagacatttactataataataaagaaaaaagtatacagaaagttttgatgaatgatggaaaattaaagaaataaatctaaagtcacctcaaggattctgcaatgtgctgtgtttaaaagattaagaagaaacatttatgatttatcatcctttcaaagttatattactttatattttaatgcatatgccattattgaaggttcttcattaaaggataggtcagcatagtgtagagcagcacagaacaggcatcaggagggttggagtcaagccttagctctgctattaccagtataatcttgaaaaaaaaaaaaactattgatttgagcttctgcttattgtccataaaataaaaataatgggttccataggtttttttttgttaaatcttttgaaatttcacaaaccattaatcaacgcatgaataagacaaatcagctattgttgggatagaataggaactatgttttatttatctttgtaatcccaacaggcctaggtatcccattaagtacctagtaatttaattattttttgttcaataaacattatcgagtatcatctaggttccaggaatagcactaaatgctgggaatttagagatgttttaaatatggtctccatcttttaagattttacaatacaaaagaggagaaaagtatacaggtgatttaaacatcaagaattatgacagaggtaggcaaagagtgctactggtggcacaaaatgggcacaatcttaaaaggggtggagaaaggcttcctggagtaaattacacctctgatgaatcttgaaggaatagttagccacattgatgaggcggcagaggttaatagcaagagcaataacaaagaaatgtaaagattataaataaatgaatatgtgatacattcattccaaattccttctaaatgtttaaaataaaacatatcctgttatataaaatgggtatgaaaccacctttatcatataataacttatgctactttattttccatatttcctttagattctaagaaatagccacatgtttatattatctgggtaagggtatatatttctttagaagaaatggaaaacctgggttttatatttatattaataacattttatcaaaacaaacttagggaagattgaatgtcacttctgcataacaattattcccatgcaactttcacgatagtaacacataccagttttgatcagggttacacctgaaagtaaaatatcattatggacaggtagggcactgaaaattgccagggacttcccataaagcacacaatttctgaaatatttatattaataacattttattttattttttgagacagagtttcgctcttgttgcccaggctggagtgcaatggcgtgatctcagctcaccacaacctccgcctcccaggttcaagcgattctcctgcctcagcctcctgagtagctgggattacaggcatgcacgaccacatccggctaatttttgtatgtttagtagagacggggtttctccatgttgagactggtctcgaactcctgacctcaggtgatccgcccgcctcggcctcccaaagtgctgggattataggcatgagccaccacgcccgggcttatattaataacattttattaaaacaacttagagagggctgagtatcttttttgatctaacaactatttccaacatctctttttataaggtcaaataatgaatctctgtgattttccaaaggccctctgagaaatttcagtggttttaggttaaaagttttagttttaggtataaaatatatcctaaagggccaggcgcggtggctcacacctgtaatcccagcactttgggaggccgaggcgggcagatcacaagatcaggagttcaagaccagcctgaccaacatggcgaaaccccatctctactaaaaatacaaaaatagccaggcgtggtggcacgtgcctgtaatcccagctactcaggaatctgaggcaggagaattgcttgaacctgggaggtggaggttgcagcgagccaagatcgtgccactgcactccagcatgggggggacagggcaagaccccgtctcaaaaacaaacaattacattatatatatatatatatatttatatatatatatacacatattatatatatatacattatatatatatatacattatatatatatacattatatatatatatacattatatatatatacattatatatatatatatatataccacctgaaatgtttattttatttgatcaaatttagaaactgattttgggagggcaaaattaagagttgtggagttgattaggtgagatcataagagtctaagaaataatacttctttacctatttaatcaaagtaaaaataaagcatttggaaaaaacacagaaggtaacactattgtaaaaatgttcattatttcataagtaaaaaccatatgctctatgggatttttttcccatagataaggacacaataaagacaatttaatcatagaacatttttcttgaaaggcacagaatctcttctatttacacagattacacagaagataaagattaactttttacattgcaagtggaagcattaatttctaaataaaggaagcaaacccaactaaactgagggaccattgtaaattttatcttactatatttaatagcttcttttcagactcaggtattataaatcaaggcaaataaaatgcactttccaagttttgtttttctttctgctctttcatatttgttttagaggatctgtgaggtcaaaacaattttcgtaataatgagatgtcatctgcccttttgactctcattctctcatgagtatacagtgttgttttccataggttacttaatatgtgatattgtaaaggattaaaagtagaagctaggccgagcgcagtggctcacacctgtaatcccagcactttgggaggccgaggcgggtggatcacaaggtcaggagttcaagaccagcctgaccaacatggtgaaacaccatctctactaaaaatacaaaagttagctgggcgtggtggtgcacacctgtaatcccagctactcaggaggctgaggcaggaaaactgcttgaacccaggtggcagaggttgcggtgagccgagatcgcaccactgcactccagcctgagcgacagagcgagactccatctcaaaaaaaaaaaattctgtccaatgattacccattaattaactcaatgtaatgtcagtccatgattttgagttgcttaaagatcttggaaataatcttcaatctggcctacttcaaagcataatagctgttgatataaaatttgtcagagtaatgatttcattttcttgaatacaactttacctcttttataatcaaaaacattttttggaataatgttaacttatttgatcagtaaacctatgcaagtttaggaaaaagaaatccaagtaaaatacaatatatccttgtattttactttacactaatcaatcagaaaaaaccataattgtcaaaataatgctaattatgtaatcttggtttctgaattagtttctgtaagagatgttttgttaaagtctagtacatttaaagtattataagtcaatttgtttgttttctgggaacttaacataagtactttatgtacttatgttctctaatcagaacagtgctcctttatttttttatttttaatatacaaaaaaatttttttaagccaacagcagcttatattcccaggaagtctcccatccaagtactaactaggccccaccctgcttggcttcacgagatcagatgagatcaagcacattcagggtggtatggccatagactaatttaatatcttataggaaaaagtttcacagattcaatgagacgtaaaggtctttctgaattacagccacacagattcacagagaacttataacttcagatctacaacttcagccacagatcaagattaaacacagaaacacaaatatttgccaatcctgatatcaaaaagctattcttcttcctgatggcataaatttttaattgacttgaagacaaaattggcagacaaacaaaactcataagggaattctgttttctcttgcctaacaggaaatactcctttataatacattgctattaatctatataacctattaatgcagagattgaataatcatgcgatgatatcagattcccagctattgctgcaccaaatgggaataacttaatggtcatgtataaattagaaataaaataataacccccaaaataatccaggaaggagaataacaaatgaaacagagtgtacaaagttaaagttcattggttgctttgatttacctctgggaggcaagaaaagacctgcccaggcttaagcagctcaagagctggacttcttcagtaagttgcttcctagccatgtgatctcgagcaaacagcttaacttctcccattctgttactccatagggaagctgtgtgattaaaatatgatgatgaacatgaagacatttaataaaactgtaaagtgccatacaaatgttatttataaatataagaatcaatatgatcagtacaagatatgacattaacattaaatatggatttatattatgtattaagaattttactttttcctttgttatcaaacagcagaatatttgctcttagagtcacagagtgtatagttgaaagacctaatctgaatctgttattttcattataagtgagaaaactgaggctcaagagaggttaaatgatttcttggaggtcatatagctagagtagcggcgtggtgtaatatgtaggacacattggtctattctgcttctattctaatgtatcagctagaagttgttttgtaaactatttttagagttttattttaatagttaatgtatttctttattagcccacatataagaaatggtttctgtagcttattgtgctttgtggtataattcatagcaaataaggcattatagtctctgattcatgtgtagaaatcttaagtcctagaattttttttttaggataggtaatacgtttgaatatttttgtctttatatttcactaaatattcatattttattctctctttgggcagaaaatgactgtgcttgtttcattattcaaccatgacctttctatatttattgttataaaactagtttcaccgttatcactaattttgttaacaaaagaccatgaggtctgcaaaggaaaaaacaaaacaaagaagagtcttcttttctttcctctttttttttttttttttttttttttgagacagagtttcactcttgttgcccaggctggagtgcagtggtgcaatcttggctcaccgcaacctctacctcccgggttcaagcgattctcctgcctcaccctcccgagtagctgggattacaggcatgcaccaccatgcccagctaattttgtgtttttagtagaaacggggtttgtccatgttggtcaggctggtctcgaactcccgacctcatgtgacccacctgccttggcctctcaaagtgctgggattgcaggagtgagccactgcgcctggccgaagagttttattttctaaaaaaacaatcacagcctctgttgtaaactgaaagcatgctattgggaaagttcccaccccagccctcgatcaggtccatatgtgcaaatgaagaattcaaactctttcagcccgaattcgttgaaaacttctgagtcccagatgggtagttttcaagccagaaccagaagtctctgttggatgctcctttcaggctgctggtgggagttttcctgccactgtgtctcagctccaattactggttacaggaactgccttagctcagaggcgcaaacaggatgttcgtctggaactgccctgtctaggaactattttaaattttaacatgtcaaaaaaaatgtctaaaatacagagaattcccaaagctatgacaatcaaggcagaaataaagtaaatgtaagggctgagcatattactcatacagtcctggtctggtgtcctgggttagctgtcaaccttagatgttgtcttcttggcctggagatggggttttagtaatctgaatttggtattaaacactggcatttatgtccaagattctccaggagttggtgccatttttaggtgagatatatgtatccaagagtcaatacactgtaacttggcagcacagagattgattaacagtacctgaaaagagtgcttcttccaacaaggctgaaggtaatctttcaattgatgtctctaccaacgtacataatcactaggctggaggctgcgatgccagaggtcactatctgatttgggcctgtaaaaggattccacaaccttgtggcggttagtctttaaagctttgacaaggcattggtagtaggttaggaagtctccctgtaaccgagcagggaaaacgtttcttcaaccaggtgcatgagcagaccggcaacgatctcaaaaggggagagacagtgtttcctactaggtgtggattgtaaaactagcaatgccaatgggagggccttatgccagggcaggttaaaagtacttgggatcttcacaaattgggtttttataaccccatttatctatttaaccagcccaaaagactggagtggtatgcataatgaaaatgctgcagaatgggctaaatgttccaaatttttgctaatacttggccagttaaatgagttccttggttactatatagctcagttggaattccccaagaggaatgatcttttcaaggagtactttggctactgacatggccgtagtctgtctgcaggagaaagcttcaacgcaatggaaatacatgtcaaccattataaggacatttttgtatccatgagatgggggtaattggatgaagtcaagctgccattctgcaaaaaggccattgggaagtgatacttggcctgaaggacattttaggggttcacctggagtatattggggacagaggctacaaagtttgtatacctaaaaagcaactgttggggaaatttctccgaagtattgtctgacccatttattcactgtatccagattgtagtgaattaggttatgtataaaggtctgtttgtgtctgtagactgctagggaggattggatgtctatttgtcccttctcataatcttgtttgggagttaaatgtgcaactttgtttcatccatttccccctttcaagatatgaaactgctttctgagatgtgaaaagtctagaaaaatggtaatcaaatgggcaagcatgggggctgaggattgaatgagcatgatcaagggagttacttgtagggctgtagcttcagcagctgcatcagcaagatgattgcccttactgtcttcagagttttcaggggagtatccttggatcttgataatagcaagagataatagagcctgaatagcttttagaagtgtcaaaacaaaaatctttatttttaataggttgtctggaggaggtcaaaaaacctcattgtttccagggcatacgaaattatgtgcaacaccaaagacgaatctaccatctgtataaaatgttagttgttttgcctccagccagcaaacaggctcatgtgaaggcatgcaattctgcttgttaagctgaccagaccgtgggaagggggtcctattcaatagtctctgctggggaaactatggcgtatcttgcgaggtaagagccagcagggctcttgagagaagacccatcagtgtactagacaaagtccagattgggcagaggcatttcctttgggtatatgctgggtaaaaggagggtatctgtaaaactgacacagtcacaggatgtcttccactggagatgataaaagggttttaatagattgcagtgggcaatggctaaattgggagaaaaagaaaatagtatctcataggtcaatcggctggctgaaagatgttgggtatgatgaaaagtgaggaggctttcaatggaatgaggggcatacatagtgagaggggactgtatgactattttttagtggcctttataagcatagaagtaatagcaacagttctcagataggggggcaatacttgtgccacagggtactgctattggctataatagccagtcagttgatcgttgccctcaaggggctaaggcaaaccccctaatgtgttaccctctccttcatgcacaaaaagggaaaatcataataatttggatgtcataggtaggggtagtggacaattgagttttttaaacttggaaagcttgttcaccatcagtaatccagacaaggaaatggggaaaagaggctttaggtaaggaatataagggttgtaccatcagagagaaattaggttccatattctgcaataatccacaggccctaaaaatactctgagctgcctttttgtagcaagtaaggggaagaaaaagataacttgaatgtgagagggatcaaggcttagccttgaggaagttaatacatatccaaggaatttaattgaatcttgaccaaattgtaatttttctttagagacattatgacatttattgagggtcagttggcagaaaaaaaatgaagagtgtcagcagggtaagtgttttgagagggagaacataaaagcatatcatcaatatattgtaaaagggttgaaccttataaaaaggttatctttttcaggtctgctcaaagaatctggaaaaaatagatagggctctcagtatatccctgaggaagcactgtccatgtatactgttggcctctccacatgaaggtgaaaagaaactttcaggtaaacagggatgctgaaaaaggcaatgcagaggtcaagagtagagacatattgggtgtcagaaggcatattatgtaagagtgtaggtggatcaggcacaatggggtgtcaagaataacaatattggttacggctctaagttgttgaacaaacctccatcctctcctgttatgtttctgcacgagtaaaattgaggtattgcatgggctagcacaggggacaatgagtccctcagaaataaaataatcaatgatcggttccatgcctgctaatgcctcagaattgagggggtattgtttcacatttagaagagaattgttaggatctatctgaatgaaaataggtggtgctgagtgaaaaagacagatattggtattcgtttttgcccatagggtctcagataattcccttaaggtaggttattcagaaatggctggacagacaggggctcacaagggaaacacataagtgaggtcttagactgggcgcagtggttcatgcctgtaatcctagcacattgggaggccaaggggggaggatcgcttgagcccaggagtttaagaccagcctgggcaacatagcgagacctcttctctatatgtaaaaaaattagccagctgtagtggcgcccacctgtgatcccagctactcaggaggatgaggtaggagaatcacttgagcttaggaagtcaaggatgcagtgagccacgattgtgccactgcactccagcctgtgtgaaagagcaagtccaccttatttaaaaaaaaaaaaaagtagaggtctcaggtgagcttattcttaaaataacacatttcccttatgggtaaaagatgttggcttgactcttttcaaggaaggcccttgctaataaatgtatgggaagagaggggaggagaaagctatggtatccaatgatgggccctatctgataaggaattggatttcacctgactatcattggctggctggggatccctaccatttgggtggtttgactactctagggaaggcgatctgaaaaaaagagttggagtttagcactgagagtgtggcaccagtatctatccacgcctggaccaatttgttatttatttgcaaaccaaccttcttcagctggttcacagaaggaagaagattgcctttatctccctgaagcaccccaatcttgtaatgaagaaaaagcttgcatttttcttagctttatctgggttcttctgaagccatcatttgtatatttcataatctcttttgtagtgataaaagcccttgcgaaagaaatagatcctgtttcccagactcttgagaacattttggttctgtgattgttttttaaattgctgaatatgtagggccatgaacgtggtggtcttttcctgataatcaagtgtcttatttattctttctttgtctctttacaaagttttagagagatagtttgccaaggaggcaatttcgtggggtttcttaaaggtccaattgaggtaatgttgtttgactaaggcattaagagttcagttaagccctgaaagaaaactagaatcaaaaagattaatggtatcctctgttaagtccttgacaccagaattttgctggaaagattttttttttatttttattttttcagacagagttgctctgttgcccaggctggagtgcagtggtgccatctcagctcactgctacctccgcctcctgggctcaagtgatgctcgtgcctcagcctcctcagtagctgggactacagacatgcacaaccatgcccagctaatttttgtatttttagtagagacagggtttcgccatgttggccaggctggtctcgaactcctgacctcaagtgatcctcctgcctcagcctcctaaagtgctgagattacaggtgtgagtcaccacacccagcttggaaagcctttttgaaccagtcaaaataatctaagcagactcatcttttttttgagtgaatcgttgaatggctttccaattaatttgccagagaaaaagcactggaatgacctttaacaaatcacaggttattttctttgcttttgttatggccatgtcccttttgaaatggcagtcctctggaggttttatccatttagttaggcatatacatgtttgagccacaaaaatgacccccagcatgtgaattaattgatagattttggtgagtctgggctagtatgcgcttacgattaaatgaaagtggcattcaaattcaaggaagtcagttttaggacaatcgccaagagttcagatttagactaaggaatgtaagaaatggtttgacctccctctacattttcacttattttaaatggggcaataagaggagttgaggggttatgggtagtgtgcctgggatagacagtgaggagaaaaaaggaggttcagaaagtgaagaaggtagtggcagaggagaataaagtagaggtagtgcagagggagtgaaaggaagaggaacaaagggtttgagtccttcttgggaacagaatctgggctaggaggattttcaagtttttggaggcactgagttcggaattagtttctctcaagaaggcagtctgaaattcttgattccatttggagttttcatagtacctattaaggaaagccttatattgtctttgagaggcctagattcgtctttgttctaattgcaggcataaataaatttgattagggatacagaaagctccccaatgtagccaaagaagttttaaatccaaaagtttcatccagagccttaaataggcacaagaattttctccataggtttttaaatataaaagtcatcagtgcaccataaggtggctggttggagaccattaccttagaacatgggttacccatggcactataacaaaggcatccctttgagtacaacagaaacatgagtgtccccacaaaacttgaaatgtgagcatactccaccaagcacaagtacattgcaaaatgcaaaagtactccacgaagtgtgagtgtaccccacagggcccatagaggcaagtgaacatgctccctggagaaaacaaagtctcggagacctcagcctaagagcccgagatctgcagatgggggaacacagcctccaatgtaaactaagtgctccgaagaacaaagagtgggtctggcttaaatagggaaagttctcctcccagcccttaatcaagtttgtgtatgcaaataaacaactcaaaagtagtccccattagttgaaaacagctgagtcctgattgggtagtttccaagtcccaaccagaagtctctgttggatgtcactttcagaaaggcagctggtgagttttcctgccattgtgcatgctactcttcaaaaggacaactgcctaagctacaagatttaaaggaaacatcctgtagaaataggcccaagggtcttctcaggctatgttctaggcccaatttacctccaatccttttcctccttaaaataatttcttctcacagcctctcttctgtatatatccaggcagggcaaagcacaaatatgagctaaggtgatattttaaatagggaatacacaaaacattagaaggagatagagtgagcaattatcttaacaatggttatgatggtggtaggagaaaaaaggagagttttgagaaataacctctcctatatgtgcctgcctaagtgtaatttatctgtggtactttatcgtcctaatgtgtaatgttatatttaaatggttcactggaataattcaatagattgtagatcaatgcttcaggctttatcacctctattttacaagtcatgcttgctaatggaggttaactgtttgcagcttccaggggaccctagagggccctggttttctgagaaccacagttggtagaagagcccaagttggagcgattttttttttttttgagacagaatcttgctctgttgcccaggctagagtgcagtgacacaatctcagctcactgcaacctccgcctcccaggtacaagtgattctcctgcctcagcctcccaagtagctgggattacaggtgcccgccaccgtgcctggctaatttttgtatttttagtagagatggggtttcaccatgctggccaggctggcctcaagctcctgaccttgtgatccacccacctcggcctcccaaagtgctgtgattgcaggcgtgagccaccgtgcccagccagttagagtgattttctaaaagccacttttgatgcacctgtagtcccagctacttgggaggtggaggcggaggcgggagtgctctcggaccaaactgagggtggggctgctatttctcgtgacctaataacaagatgcagataaactgtggaggaagagagtttttatttctgtaactgtttacagggaaaaggcctggatattatcacgaaaccaactcaaaatcacgatgttttccagagcttatataccttctaagctatatgtctacatgtaagtgtgcattcatctaaagacataagtgattaacttcttttaatctataaataaggtctgaatcttgaagatcttcctctggagcctcagtaaatttacttaatctaaatgggtccggcaaggtgcggtggctcacgcctgtaatcccagcactttgggaggccaaggtgggtggatcatgaggtcaggagttcgagaccatcctggctaacatggtgaaaccccgtcgctactaaaaatacaacaaattagccgggcgtggtggtgggtgcctgtattcccagctacttgagaggctgaggcaggagaatggcgtgaacccggaaggcagagcttgcagtgagccgagattgtgtcactgcactccagcctgggtgacagagcgagactccgtctcaaaaaaaaaaaaaaaaaatctaaatgagtccaggtgctggcgtgattacccttatcttgtctcctgctaaatcacagaggtttggggagttccttcggactcccaacaaacttgtttgtggaggcctggggagtttcttcagacccacaataaaacttgtttaatcctaaatgggtaatgttaagacttcctttgttattttgtcatgctttagggcccaggaaaggcctaggcaaaactcttggtgggctttagttacattccagcctttgtataagggcactggctttttttagcttttaatattaacttcaccactcagtactgaaacagttgttatggaggcctccgttagtgagacgtggcctgccacaggaggactgcttgagcccaggagttagaatcaagcctgggcaacagagcaagaccccataccttataagatgccttttatttttagtttttttattttttcgagacggggtctcactgtcgtccaggctgcagtgcagtggtgtgatcatggctcactgcagcctcagccttctgactagctaggaacacaggtgggtgctcccacccccggctaattaaattttttttgtttgtttgagacagggtctcattctgtgtcacccaggctggagtgcaatggcaggatcttgggctcactgaaacctctgtctcctgggctcaagcaattgtcgtgcctcaccctcctgagtagctgggattacaggagcctgccaccacgcccggctaatttttgtatttttaggagagacaggatttcaccatgttgcccaggctggtctggaacttctgacctcaataatatacctgccttggcctcccaaagtgctgggattacatacttgagcgatggcacctggcctaaaaaataatatttttagagacaagggttttgctatgttgcccaggctagtcttaactcctgggctcaagtgattcttcccagtagcttgggattacagccactgtgcctggtaaggcacttttatttttcatatccccttagccaactcgaagtaaaaccatctctcaaatgtatcttgacaaaacctggcagcaaacaaaaaaatctcaaacttgtctgtcattaaaagattgtggtacccacgcaacgacaccaactcaatgcttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtgccgctgccccttagctggcttctgcccacgcccggcggggcccttctccggctacccggccactcggggttgcctgtttcctcttcccattattccggccgctcctctccctcatttcttcagctccttttccggtctgcccccgcgctctattctccgcctccgcgtcctccgcccctccttccaacggctccgcccctccgagctcgggttttccaccgggctcggcagtttttcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaagtgaggcagaacgggtagtgcctgggttccccccgagtttgcgactccttttccaaagtcttttcctgctgtggctttcgcgggactctgcgagctgggtcgcttagattcatgagtgcttgggaggttcctcgtcgggccccggaccagaaaatagttttgaaaactaagtgaaatcggccacagataggctttttggcggccgtgctccgatgttaacgtcaaactttagtagtggtggtggttcctgctctgttttacatagccagtttaaaaggccctcacattctgatttcctctttcagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcctaagaatctcagggttgggtcttttaattttaattttttttaagttctggggtattctgggggtacatgtgcaggatgtgcgggcttgttacaaaggtaaacgtgtgccatgcatcacctaggtattaagcccagcatccattagctttttatcctgatgctctccctccaataaggaactgacacttgaaccttttcgaggtaaaataaaatcgctagctgaactcactgtagccctttttgaatacacaacttatttgaatatgacaattgagaactttactggagagaacttagtattttggggtgagagaagaatgggaaattaaccactgtagtccacctttacaataaaaaaccctaaacacagaggagcaaaataatttacccggggaagtgtaataaattgtcaacttgacattagtacttgggcttagatctaaaggagtgttctgcctgctgattggttggattggtcatggagaaattggaattgtaagattgtttacatttctgttgaatgtgagtgaaatgaatccagtcaaaaataataacagctacatactgtgtaaattgtttcctcttcagaggaccgccctgatggtctagttaattagacttctagtgcattcagaagaactgcttttggggagcaatgcagttttgactgttgtgaagaaaggtgtttcgttttttcctttcttttttttttttaaagtctagtttgaggagagaaaagtctttagaaatagacattaccaacagattcgtgattaaaaatgtatctcctaggaggtaacagagcctttggcactgctctgaatgctttgtgtatattaactttacttttttaaacaatcctgtgaactaagtactgttagtatctccattttacacatgaggaaactgagacacaagagtggttaagtaatttgtccagccgggaagtggtggacagataacaatctggtgctggagtttatgttctttttttcttttcttttcctttcctttctttctatttttttttttttttttttctgggacggagtttcactctgtcacccaggctggaatgcagtgatgctatctcggctcactgcaacctccacctcccgggttcaagcgattctcctgtctcagcctccccagtagctgagattacaggtgcacactaccacgccccggctaattttttttttctttgtattttagtagagacggggtttcaccgtgttgcccaggctggtctcaaactcctgagctcaggcaatccacctgcctcggcctctcaaagtgctaggattacaggcatgatccactgcacccctccggagttaatgttgttaactaaccaccctagcataagatacccaaaaaggacttatctactcacttatcaatctccttgctctcatttaaaatagttagatgattttacatttcaaaattgaattgatcctaatattctatatttgcatattcatggagatctatccttgactatttctgggatagcacctcacatgtaaacccataagaagtggtcagggtttttcattattgatgcctgtctgtctctattgtaggcttgcttttctacttggggttgaatagaaatgaagtatagtttcacatacagtatgtcaaacctggatcttatttggattcaaggccatgcccaaagcatactccagatggcccatcgtacaatggtttcacttagagtttttcaactttatggtggtgtgaaagcaatacgcatacacattcagtagaaaccgctcttcgagtacccatataaccattctgttttacacttggagtatttaataaatggcatgagatagtcaacactttatcataaaataggttttgtgttagatgattttgcccaaccacaggctaatgtaagtgtgttctgagcatgtttaaggtaggctaggctaagctgtgatgtgtggtgggttaggtgtattaaatgcattttctatttagaatattttcaactgcttttttttttcctttttttttgaggtgagttctcactctgtcacccaagacagggtgcagtggtgcaatcatagctcacttcaagctccaactcttgggctcaagcagtccttccgcctcaggctccccagtagctgggaccacaaccaccatgccttattgtttttgtttttattttgattttttagtagagacaaggtctctctatgttgcagagagtggtcttgaactcctgggctcaagcgatcctcccacctcagcctcccaaagcgttgggattgtaggcataagccactgcacctagcctgttttcaacttatgatggggttataccccgtcacaaggctataccccatcgtaagttgagggtcattggtactagagagcaagtagcatagcactgaatcataggccataatgtcatcatcagtgataaagtaatgtatttttcaaataaagtttctagcactttttattagagagcaactgataactatactcttgtcattttgaatgtataattgaaagacctagtttgtagttctgtcaacttaagttttttaacttttgatttctagctataaagcttcgtggggaccttaacttatttcaaattgtgttgaacaaatttgatttatatttgtaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatctctgtgttgtatttctatgtgtatctgtggctgtttctttgcatatgtgaatatctgagagagtgtgtgtatgtgtgtttatttaggcgtgcatgtctccaagacactaattttggagttctaaattttgagttcattatttagattttcattattcaaggaagacaatttgctcattttagttaaaagttttgcctatagtaaatccactaaaatccctaaattatatttactctttcatttattcagttacacccaatatataaaaggcactgttttaggtgctgtggatacagtagtaaacatgagataaagtccctgttcttatggtgcttacattctagtggtggaaaattgataataagttcacaaataaatgatcaaggtatttcatgtggtgaaatgtactatgaagaaagtaagacagggtgatgtggtagctggggtgaagactgattagaattgtcagagaaggcttggcagagtacctaacattttgatctgagacccgaaatacaaggaagagccagtcatgtgaagatttggaggcagaaggaacagcaagtgcaaaagcctaagtaaggaatgaacttggagcttggtgtgtttgaggaacagagggaagattagtgttgcaggagcatagtgagcaagggaatataatagaagatgaagttgggtgggggtagcttatgtaagagttctgattttattcatgtttattgagaagccattgaagtattttaagcagagaaattatggtaaggagtattattttctacaagtatattagaattcaacaggaactgatcatcgtaatagaaggatgaagaaaattacttgtttgttttctattagttcttccttgagacactagaagcttgccaaagggccaggtcagtaattcccacttgtttgactttaaaacctatcctagtttgatgttgcaagaagtaaatgcctcatagaattactatatatgtgtatatatatatttatttacattatagtaaaatgaaattaattttaaaataaaaaacctgagaagaaactggctggagcataatttttcttttagttttactgcttctgtctcttaggcactcagtaaatacttattcattcattaaatatttattgagtaccttctatgtgccaggcattgttctaggcacttggtatacatcagtgaacaaaacaaagactcctgttcttaactgagaggaggcagattcattgattatttcaggagtgaaattgttggtgtccttatcactataatgttggagaagagggaatgtcagggtggctgtgtaacatagaagccagtcttgaactatttagtgagtcaggagagaagctagattaaagaggaataaacttatcttcctaactgctttatgcaagtcaattttttccagatacttttaattagtattttcattctaaatgttaaatcagctttgattttgtgttagtacattaaaaggaaaacactgatttcataaacatatcctgactttttactcatgctgaaaaggaaggaaactgtacaagtctccaatttattttatttttatttttttacagttttaaatgtctttttttctatattaatttcaagaaagtcacataaaagcagtaagcagtgagaaagaatcagtaattgattggttatattttcttttctttttttgagacggagtttcgctcttgttgcccaggctggagtgcaatggtgcgatctcggctcacctcaacctccacctcccaggttcaagcaattctcccgaatagctgggattacaggcatgcaccaccatgcctggcctaattttgtatatttagtagagacggggtttctccatgttggtcaggctgatctcaaactcctgaccttaggtgatccgcctgccttggcctcccaaagtgctgggattacaggcatgagccaccacacccagccaataattggttatattttcattttaggtaaatcatttattttccccagacctaggctggggggtagtatgtttgttctaatttaagcgattggtttaaataaatttccgatgtaatggttctatgtttaaaaccttatttccagcatacatggtggtgtggtatattgtttaattgtatatgaagttatgatagtaaattactggcaaagattatttcacagtcttcatgcatggtctagtagtttccccagcttattatcttgtctggcagctattacttttggtttcaatttttaaattctgttttcatgaatgaattgtgcttcagtttaaatatgcccagtcctgagaagtattacaaagccatgtgaagacatttttcatgaaatatcatttctgaaatatatcagttgacataggagataaggtatctgctgaatttatattgacattttatagtactctttgtattgctttaataatcctagtatgtatacttattaaaatatataaaaattcacatgtgcagtttttagaagtaccactatattcttggaagttagattcagtcatcagtgggcagcagatgaagtatggaattttctcccatgttacctaatatttttcttcttttgttttagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaatatatggttttaaaattgacttaacttgagcaagatacattatgaagttctttctgattagagtgtgtggtctcaagacctttacagtagattatccttaagtgtccatagctctctggtacaatgtttagatatagtttatctatcaaaatagaacattcactataaagacctctcttccattccaatcatattatcccaacatgctaaatgttccaaacattttatttggaatgcattttatcatgtttttataggtttatttttctgattgtgttttatttaggctaatattaaaaaaatgcttactagtggtagaaggtggtgacaaagaaatactctgggtagcaggaggaagccaacttggattaaaattttgctgagaataatctaaaaagtgagtaatctggttgagaattcacagcaccataatcataattgtatatcaatgttatgttttaggaaaggtcctattcaaatccagggagagaatctttagtgttttctgggccctcataaatacgtttttctcatttgagaaaattgtgactttatgttggtcacttagtttttatagtttatgatgaagaattaaagagaaacaaatgaaaggcaaggtctactcaaatatcagacaactaaaaggctatacagcccctaaatcctttgctatctacttccccagaataatgcataacctaaattccattatttcatttagcagaggtttaagccgttgttgtcaattgtgtgcagtaacgcctctgacttcccttttgtggaattttgtatcgattttggatttttaagtcaaaggagactttaaaatcattttgatttggcacggattcttgagattatctagtccaattccatcatattcagattttaccatttgcttaaagtatagcttttggcagaactgcccctaggagcagctccttgattcccagtcccctgctctttctaccctgcataatatatgttgtaagctttttgtttctttatagttgtttgcctagtgttcattttagttactcgaattccttgcaaggtaggttttgtttgtttatttatggaagttatttagtaggaatttcacacttaactgggttttcctttggcgtatgacaaccttacctaggacttagaaatctgtgatttctgagtttttggaatttaggaaaatgctctgggtaggattgatagtagattgaataaattaagactttaagacagaattgtagacttttggagttgggagataatttaaagaatattttaaaccaccagttttacagatgaggaaacatgctaaattaatcaccacatttacatcttattagtccttattaaagaatggtaaccaaaagtctgtttgaaatgtttgctctatttgtttggtttcattacatgacagagctgcaggttcttgatattaatgagtaagtggaatgcagtttatttagcagtgttctattagaggtactgaaattttcagggataaggaaatgaaagagagtttagcattgggaaatttgcaccatggatagattaagaggtagacagttaatagaacatttacgggttggagtagatgaaaagagatgtgatgttttgggatgaccttgggaattaaggattttagatacttataatttgggaggaaagaaagctcaaaggatttgttggtaagatagtataaccaatgaatttgacatagggttctggaacatttaaaagtagtcattatctgcaagtaccatcaagtatctgattttggacaccttagacctctactttttaattttaatttttttttttttgtattttagtagggacggggtttcaccgtgttgcccaggctggtcgtgaactcctgagctcaggcaatccgcccgcctcggcctcccaaagtgctggttttacaggcgtgagccactgcacccggctctactttgtattcttttaaaggcaagtcatatataggcacaaaagagtacaaaaaggttgtttgccactttaatatttagtttgaggaagtttttcaagactaagtaatgactagcagtaatataaatattcttcctggccctttattgtggtataagcacgtaattcctctgatttgttcataaatgtaaaatttgtggagatgaccaaaacacttcatatagtctgagaaatgacacatggacagatcatttgaaattaattttggggaaacatttggaaagggtcatcatgatagccatgtggtgatcaattttctgctgtacatgtaataccatttatttatttatttatttatttattttgagaccaagtctcgctctgtcacccagactggagtgcaatggcgtgatctcggctcagtgcaacctccacctcccagtttcaagtgattctcctgtctctgcctcccgagtagttgggattacaggcatgtgtcaccccgtggggctaatttttgtatttttagtagagactgggtttcaccatgttggccaggctagtctcaaactcctgacctcaggtgatcctcccaccttggcctccaaaagtgctgggattacaggcgtgagccaccacacccggccgtaatacgatatttttattggggagtggggagtgaaaaataattttggttaacactagtgcttagtatgtatcaggtactattcagagcactttacacatatatactcatttaatctttaaatattcctgtgcaataattggtattgtccattctacaaataacataatgtgaaaaaagttgtatttcattttagggtccaagagatgttgtggaaattgtaatttgaacactgaattccagtatacttccatcctttatggggacagtaggagagaatatttgaaatcagaggattttcctaagaaatttagattgtatgttagccacaggcgtaacggtatgctagccataggtgtataacctttttgaatttttacattgctacttaaaaaaccacagtgatggctactcatagaatccatgtgtagaatccatgtggagaaactctttcaattggtttacctgattgcaagttatttacaaatctttttcttttttcttagttgtattttaaagtttcattttggtccttgctttatttcttttcttggaattttcagcattcccacagcttctactgttgactcctttatctgtatctcccaactctgatttgggctcctaaatgatatttccaattgcctttggccctgtctgtctgttaattctgtaagcacctcaaactcaaggtgtgccccaaactgaaatcatatttcttttcattcttctgaggtgcttatctttattaatggtatcatcatttagtcattcttctagcctttaactctgtctccaaccccttatatctaattggtttccaagcactcacagctttatttcctaagtacctcaagcttatgtattcatcattcaggcttttaatataaatgcataatgagaatctaccttttgtatcagcaggatccaagacatgattcctgctctgaaggacctatgtcttactcatttttgagtcctttgcctgaaacacagtaggctttccataaatgatgaatgcacttctgtaacctagtactcttttttgattgtcttgattaggattaggtattgttctaggaaacactgtcatcttgtacacatttatttcatactgactttgatttgacagcgaagtatctagtaagtctcttgttcagaagatgtgaccatcatattgtatggtaagtttgtaggatcaagcacatataagaatagcatcccaaatataacagtgctgattctatgcagtatcttaatggtatttaagggtctgtcaaataatggtacctgtcagggatttgtggcaaaacatgatgttaaaaatcaggtatatgaaaagcactatagtgttttctagtaaaagcttacatagagaaaggtttaggatattaccaaacaattttttttttcctttgagacagggtctctctgtcaccgaggctggagtgcagtggcaagatattggctcctctgcctcccctggtcaagtgaccctcccacctcagcctctggagtagctggaaccacaggcatgggccactacacctggctaattttttgtagagacggggttttgccatgttgcgcaggctggtcttgaactcctgggctcaagtgatctgcctgcctcagcctcccaaagtgctgggattacaggcgtgagccactgtgcccagtcatcaaatgatatttaattacttattaagtggctaatggctaattccctacgtgaatgctctatttattatacagtttttaattcttttttttttttttttttttttggtaggcggctaaacaaaaggtagacaaatctggctaggttcaaacaggaatgtagaatacatgatgctatttattttttttttttttaacggagtctcgctctgttgcccaggctggagtgcagtggcattatctccgctcactgcaacctccgcttcccaggttcaagtgattcaccctcctgagtagctgggattacaggtatccaccactacatctggctaatttttgtatttttagtagagacggggttttgccatgttggccaggctggtcttaaactcctggcctcaagcgatccacccacctcggcctcctaaagtgctgggattacaggcatgaggcactgtgcccggccagaatacatgcttcttaatgttgatactgattcttgaaaaatattttgacaggcttttaataccattatataccatctatgttggtatttctatatcttcattgtcttataaattttttaccatattctggccaaaattacttattttgattgacacttgtatcatagctttgaacatgattttattttggtggctgcagtcctgttctctgaggcagtggttcttaagcttctttcagccatggaactctttaatttaaaactgtggcttttcttctctatatacatgattttgcagtgactttcagaaagtttgcaggacctcatggccccgggttaagaatccctaggctgaggcgaacttcagtaacttcatttcttggtcattgtttattactattttggtcttaattcctagactcatttgtaattaaacccttttgattaattacatttaaatttagtaattcccagtttttatttttatttctatttttatttatttattttttttttgagacaaagtctcgctctgtcgcccaggctggagtgcagtggcgcggtctctgctcactgcaagctccgcctctcgggttcacgccattcttctgcctcagcctccggagtagctgggactacaggcgcccaccaccatgcccagctaattttttttgtatttttggtagagacagggtttcaccatgttagccaggatggtctcgatctcctgacctcgtgatccacccgcctcagcctcccaaagtgctgggattacaggcatgagccaccactcccggccagtaattcccagtttttataatgtaacacaaattcaatactttttttgtttaaagcatactagccaatacatttttgaaactaaccttaatattcttatgctattaactcagtatctgtaacccataatgtcatatagtgtcttttctaatagataataaggactaaatggaattttttatttgtagtaattattttagaatatcctataatagactggtgaagaaatccagtaaggcaatacaatatggtgtttactcatggttaagtgtgctactaaagtacttggttgcaggaccctgatagtcactgttggaatgatgtctatgagacgcatatagtacatctttttgaatgatcatttctccttttgtgcagcattacatactggtcaattctccactgccagtgtgaagtgaggggataatacactccccatatttagtaatgaaaaacattcctaagtccttagcctaaattagtagttttctggatctcagttttcctgtttgtgaattaataaaactaacttctcgggtgatttctaagacataaacctagttgtgtggcatgttttaaaaattaaaaatgctgttgaaataacacattttctcttggttagtttttgttttgagaagtaggactaagatctatttttagaattcacagaatatagtcctaaatgatacggaaagcagatttttcattgaatttcatgtttaaactcatactcagtttctaattggggttatagttagataatttaagtttatttagaagtttaattgaatgagtctttccagtgcttcaaatgttctgggttttttccctccttctgctaatcctgtctctagactgatcagacactgcaggtatcttaagtcaaaaaacaaccttctgctgggcgcgggggctcatgcctgtaatcccagcactttgggaggccaaggcaggtggttcagctgaggtcgggagcttgagaccagcctgaccagcatggagaaaccccgtctctactaaaaatacaaaactagcccggcttggtggcacatgcctgtaatcccagtcgctcaggaggctgaggcaggataattgcttgaacctgggaggcagaggttgcagtgagccaagattgcgccattgcactccagtctgggcaacaagagcgaaactctgtttaaaaaaaaaaaaaaaacaaaccctcagtgtttgtgtgccagtgtggtatattttaaagcaaagtaatattttcctttaaaaaaaaatctgtattgtcatgctatcaggtggaaatggggaagagaagaaaatgaaagcaagtggttcttgataatattttattttgcaattccgaagaaggattacttctttgggaaatccattctttgtcttgcctttatttctccttcctaaaacttgaggaggaggttgaacagggctgccaggccatgctttgttttagaaccattgtgttcccttccttcataaatcttgctttgctaattctgcttgaatgttcaccctgaaaagttgataggctctagttccagggtgctgttaaaatacatttttaaaacacattaccattatattttcagtaatgaaagaccctaaaaagaggttctgtagagttatttcccttaatttgcttcatgttatttggtactaaaaataattgaagtaagttatttagggctaatttttaaaatactggcttttcagtaggttctgttacaagttgttatatgttaatacatgggtttgttatctttaaaaatctaggtctgtttatgtggtaatgtcagatttattcatttttatgtgggccagtcatccccactttttgccaagataataggctaacacccaaaagctatttttaatattgatcacaaatttgaccacttaaaggaaggtgttatcaatattttaatattgattacaaattttaccacctaaagtctgttatccactgttgaatcacagagtaattccctacatttggaagagtgcttagagattatgcagcccatctacttattttacagatgaggaaactgagacttaaagtggtacagccaagttcataacattcttttcatgataccatattgcctctcagaaactaataactcatagcattttgtcatacacatttacaactataccttgtatgtcacaggtaatgtatgctttaaaaaaataattccggacatacctcatttaattggttgaaacgtgaagtgttattttagaattaaaatcattagtatttatatgtcacactacagtttccttgtttatcagtgaagaaataaatatagcaattaaaagggcaaattacgtattctagctaaatttcagtataaaaagtagtcattgcaaaattaaagcccatcagtttcatgacaagtaaactatgttatttaaagttactttaatgttttttcaacttattttaatctgtacccagagatacagtgcttaaaacttaaaatgtcttttttaagacattttctttccattatacttagatgtcaaagggaataattccattagggatggggaaacaggatatggacccatattagaactttgatttccagtagaatttcagtgaaattgctctggttcttacctttttttttttttttttttttggaccaaagaatgattgcttgctgaatgttttgtcaggtagcagctaacagccatccatatttaagcacgaacgtgctaaacactgaatatacagtgtcttttgtattattctaacaaccttaggtttaagtcacaaaaatttctagagcagtgtttctcaaactttgaaacattaataggtgatctatggagggaagaaggtgtttgataaaggctaggtcaaaaatgtgaagcatttactataagcattccttaggacctttaatgttgctaatgggcactgtgaatctcaaggataggattataatatgcaaagtttgctgaaattttggccttgaaattctctttttaggaatatgttgttctagagcagtggttttcaaagtgtattccctggaccagcatcatcatcacctgggaacttgttagaaatgcaaattcttgggattcatcccagacctgcctcagaatcccttgggcaagaggcaatcttttaacaagccctccacttgagaaccactgttctggaagtttttcaggactaaagtagtttgctgtggagaaagccaattgggatttcaagtgcgatatttcaaaggacagtattaaataccttgaagtggctttttattatatgcaagacaaagtctagaatcgacccacagttctctttaaaatatcctattgtactaatctgcagaatggaacctctgctttaccacttctgggcttttgttcatgttttttctgccttggtatgtaattcctctttatggtaattgtgcaaacatcaggagattttatatagttttagtttcagtactgttactgattggatgtgaaaacttaggtaggtcttaaaactatttcagacctgtttcttcatctgtaaagtaagagatcccttggagctgtaaaattccaattacttgttttcccagtttatgatgctattgtttcttgctcactaatgataaaatgtttaaatttgctttctaaaattaaggtaatacatgtgaatagttaaaaatgttaattgattatacaaggcttacaacaagaaacagcagttgtatgtcctattcctccgcatctctgttcctgcttcttatagatgaccgtattactttatgttttataaataatatgcttaaactggttttgttttgttttttaaatttgaatatcattgtaaccttcctacatggaagaggagacttttcaaaaattaatgtttttaatttacacgtcacaattgtatatgcatttatagggtacaatgtaatgttttgctatttgtgtacaatgtggaatgattatgtcaagctaattaacatattcacctcacttacctatcattttttatggtgagaaatttgaaattcttattttgaagtacacaatatattattattgactgtagcgactctgctgtacaaaagatcccagaacttatgtcctctgtctgtctgaagctttgtaccctttgatcaacaactcccattttctcttttcccactcaccccccagcttctggtaaccatcattctaactctctacttctatgagttcaacttatttagattccgcatgtaaatcatgccctctttgtctttctgtgcctggcttatttcacttagcatataacgtcctctaggttcatctatgttgtcacaaatgacagaatttcgtttttctaaacactgaatagcattccattttgtatatgtaccacattttctttatccattcatccactgatggacacttaggttgtttccttatcttgggtactgtgaataattctgtaatgaacacgggagtgcaggtatcccctgacatactgattttatttcctttggatatatacccagaagtagaattactagatcatatggtagttctatttaattttttgaggaacttccatactgttttctataatggctgtactaatttacattcccaccaacaacgtacaacagttttcttttctctgcatccttgccaacacttgttatctttcatcattttaaataaaaaccattctaacagttgtgaggtgataatctcatgttttgatttgcatttctctaatgattagtgatgctgagcattttttcatgtacttgtttgccatttttatgtcgtcttttgagaaatgttcgtttagttcctttgctcatttttaaattgggttgttttcttgcttgttgagttgtttgatttccttacaggttttttttttcgagttatttgatttccttacatatttggatattaaccccttatcagatgtatagtttacagatattttctcaatttctgtgagttgtctcttcactttgttaatagtttcctttgctgtgcagcagctttttagtttggtgccataccatttgtctatttttgcttttgttacctgtgcttacagggtcatattcaaagaatcattgcccaaagaagtgtggagcttttcccctatgttttcttctagtagttttgcagtttcaggttttatatttaagttttcaatccattttgagttgattttttaatatgatgtaaggtaaggatccaacttcattcttctgcccgtggatagtcagttttcccaaccccatttattgacaagactgtcttttccccattgtgcattcttaatacctttgttgaaaattgaccataaatgtttaggtttctttctgggctttctatcctgttcctttttttgatgtgtctgtttttataccagcatgatgctgttttgattatgctcactttatatatgatttgaagttagggagtgagatgctgccagctttgttctttttactgaagattattttgtctatttgggatcttccgtggttctatataaatttaaggatttttttttttctatttcggcaaaaatgtcattggaattttgatagagattgcattgaatctgtggatcactttggtagtgtggacattttcacaatattcttccaatccataaacatgggatattgttccgtttatttgtgggttttttttttttttttcagtttttttcatgagtgttttatagttttcagtgttatatcagtcttttacctcattggttacatttatacctaagtatttgttgctattgctattgtaaatgggattgttgtcttaattttctctttggataatgtagaaacactactgattttttatatgttgattttgtatccttcaactttactcatttttttaatcagttctaaccattttttggtgtagtttttaggtttttctatatgtaagagcatgttatcagcaaataaagataatttcatttcttccttttctagtaggatgtgttttctttctcttgcctaattgctctggctacgatttgtatgttgaatagaagtggtgagagggggcatccttgtcttgtccctgatctcagaggaaaagctttcgatttttcactcttgaaaatggtcatagctatgggtttatcatatgtggtgtttattgtactgatatacatttcctgtatacctaatctgttgagaggtgtttttttttgtttttttttgtttttttttgagatggagtctcaccctgtcatccaggctggagtgcaatggcgtgatctcggctcactgcaatctccgcctcccaggttcaaacgattcacctgcctcagcctgctgagtagctgggattacaggcgcccgccaccatgcccagctaatttttgtatttttttttttttttttttttagtagagatgcggtttcactatgttggccaggctggtattgaactcctgacctcgtgatctgcccgccttggcctcccaaagtgctgggattacaggtgtgagccaccgtgcccggccaagagtgtttttgtttgtttgttttttcattatgaaggggtgttgaatcttgtcagatgctttctctgcatctatttaaatgatcatgatttttattcattctgttaatgtggtgtatcacatttgttgatttgtgtatattgaaccttccttgcagccccaggataaatcccacttgagcatggggaatgagtcttgtaatgtgttgtggaatatagcttgctagggttttgttgacgacttgcatttatgttcatcagggatattggtctgtaaatttctatttttgtagtgtccttgtctggctttggtatcagggtaatgctggtcttgtaaaatgagtttagaaatattccttctttttcagttttttgaaagagcttaagaaggattggtactggttctttaaatgtttggtagaattcagcagtgaagccatggggtcttggactttggtgggagacttttattattgattcaatctccttcctcattattggtctgttcagattttctatttcttcatgatttagtcttggtaggttgtatgtgtctaggaactcatccatttcttctagactatccaatttgttggcgtataattgtttatagtagtttcttgtgatcctttgtatttctgtgataacagttgtaatgtctcctattccatttctgatttgagtctttttctcctagtctagctaagggtaggtcaattttgtttatcttttcaaggaactaactcttagtttcgtttattatttttctatcatttttctagtctctttcatttatttatgctctgatctttgtttccttccttctgctaactttaggttgttctttttctagttccttgaagtatgttagattatttgagatctttcttcctttttagtgtaggcatttaccactataaatttccctcttagaactgtttttgttacatcctgtaagtttttgtatgttgtgtttccattttcatttgtctcaagggttttttttaatttcctttttgatttattctgtgacacattgacttgttcagaagcattttgtctaattcccacatatttgtgtgtttttcaagattctttctgttactgatttatagtttcatgccattgtgatctgaaaagatgcttgatatgatttcaatttccttaaatttgttaagacttgttttttagcctaacaatgtgatctatcctggagaatggtccatgtgtgcatagcaagaatgtgtattctgttgctgttggattgaatattctgtatatgtctgttaggtccatttggtgtaaagtataattcaagtctaatgtttcctaattgattttctgtctaggttatctgtccattgttgaaagaggggtaatgagatcccaaagaggagactttttcttttttctcttccccattttccttcctatcctcctaatttagttttatcagttctgtgagattcattttcaatgttgacattattatgactgcttaactacggtattattcacatctgagccatgtagtgttcaatgattttatttcctttcctgtaaaactttgttttatctcattttgttatttcatcattttcccactttttgatagtaacatctccaaactttccaacagaagtgtacatctctcattatattcaaacacatcgggttatctaaacctttattatcttttttgagatatccacactggagttctctgtcctatttttggaaatgcttattttctagtccttctgagtgtctatcttcctgcgatttccccttcatccttatcctgtaatttctctttgcttttctcttgtgttgaatctcctatttccaagattgctcccttccacccccagactttaaaaaaaaaattctttattttggtttcacatatcttcagtagcttttctgagaaagggtggcaacatttttgaatctttttttttttctaaaaacaccttgttttactctttcatttgatagcttgcaatagaaataaaggttggaaataacttcccctctaatctagagcttcattgttttccgaatcctagtttttcttttgagaagtatattgtgttcttatttgtgttcttttgtgtataaactgttcttcttctgtgaaagctttaggatcttctctttatcccctgacttcagaaactttattgttatgtccagggatgatcttttttgctttcattgttgtggctgcttcatgggccctttcagtctcaatatggatactcatgttctacagtgctagaatttttttatattgtcatcatcatcatcatcatcatcatcatcattatcatttctttccctctgctttcctcatttcacttcgggcttcctgttggttagatgttggctttcctagattaataatctaattttcttattttttcttcccaatattgttgactattctgtgagctcctcaactctgttatttcttctgcttttttgttttacttaactgttaaatttaaatacagtaaaattggcctgttttcttatatagttctataattttgacaaacgcgtaatcatgtaaccactaccacagtcgagatgcagaacagttccagtgcccccatttatcctttctctttgtagtcagcccttcaaccctaactactggcaaaaactaatctgttttcctttcctatagtttggcctttttcaatgtcatataaatgcaggcatacagtgtgtagccttttgactcatgtctttttttgcttcgcatgttacatttgagatacgtgttcttttatgtatcaatatttcattattttctattcctaggaagtattctattgtttgaatgtaccacagtttttgtccattcaccagctgaaaaatgtttagattgtttccagttttgagagctcatgattatggataaagctactataaacattcacatagaggttttggtgttaccatttctcttatgtagttacctagaagtgggattgcttgatcatatggtaattctgttcaattttataagaaactgttaaactattttccacagtggttgtactattttacattcccactagcaacgtatgagagttccagttctatatccttttcaacacttggtattgtcagttaaaaaaattattttagttagtatgcagtagtatctcattaaagacacacaaatggccaataagcagatgaaaagatgctcaatatcattagccactggggaaatgcaaatcaaaaccacagtgagataccacttcacacccaccaggtttactataatcaaaagatggaaaataacaagtgttgataagaatctagagaaaatggaaccctcatacactattggtaagaatgtaaaatggtgcagttgctctgaaaaacagttcctaacattaggttaaatagagttaccatatgatccagtaactccactcctaggtatatacctaagataattgaaaacataagtctaaacaaaaacttgcatgtgaatatttatggaaatattattcataatagcccaaaagtggaaacaacccaaatttctatcaactaatgaatggataaacaaattttggtttatgcaggggattgaactatgtagtgatgcaccatgctccaacatgggtggactttgaaaaccttatgctaagtaaaagaagcgagtgacacaagaccacatactttatgatcccatttgtttgaaatgttcagaatatggaaatctatagattcaggaagtagattagtggttgtctggggttggtggggatagagggattagaggttgacagctacaggatgcagagttttattttgggataaagagaatgttctaaagttgattatggtgatggatgcacaactctatacaacaaaccattgaattgtatactttaagtgggtgaattatatggtatgtgacatatctgaaagctgttaaatttaccagttttaagagtacaatttaatttttagtgaatatacagaattgtgcacatatcaccacaaaatagttttagaagatttttattattccagaaagattctttgtgcttatttgtagtcaatgcctatttccactccagccccgggcaaccacttcatctgctttctgtctctagatttacccttttggcatatttcatataaatggaatcatattccttttgaaatcatacagtttttgcttccatcttcttaggaccagtttctccaatccttgttaatgcttgttactgtctgtattgtttattacagctatcctggtaggtatgtaatgatgtcttattgtggttctaattttcattttcctaaagatcaatgattttgaatatctttttatgtgctcattagtcattcttatatctttggtgaaatgtgtattcaaatcttttgtctatttaagaaattggattttttttattgttgacttttcagagttctttatatattttggtacaaagtttttctggttagatatgtgatgtaaaaatattttattccagtctatggcttgtattttcattctcctaacaatgtcatttgcagagcaaaagtttttaattttgataaaatcgagttaatttttttttctattatgtatctgagaactcactgcctaacccaggatcttaaagattttctcctatgttttattttttaaaattttgaagttttattttacatttataccactttgagttaattatagtacaaggtgtgaggtataggttgaggatccttttttttgcatgtggatggtcaattgttctggcaccacttgatgaaaatgctatcttttttctattcaactgattttgcacctttgtcaaaaatcaatggaccatatttgtgtggatctacttctgtgtgcttccctgtgtgttaacttttctcttgctctgtctccttttgtcttcctgtccctacttgtgtttttttttcagttttctattacttttctgattctctccctccttctcctgattttcccttcccccattcccttcctcaaaatgaagcatttagattgcattgttttatatatcatacttatttttagtttaaaaagcagatgtgaagcatttgtgtttttctttacaagtacaatatgctggaaacaaattaacttttaaattataatccctttttttttttttgagacggagtctcgctctgttgcccaggctggagtgcagtggtgtgatctcggctcatgccattctcctgcctcagcctcccaagtagctgggactacaggcgcccaccaccacgcccagctaattttttgtatttttagtagagatggggtttcaccgtgttaggcaggatagtctcgatctcctgacctcgtgatctgcctgccttggcctcccaaagggctgggatcacaggcgtgagccattgtgcctgaccaaattataacccttaattaatttttctcagtgaattagtgaccttaacgaaagatggcaatctctcttcccaaactgtgtgtttcagaacttctgcaaaaggcatcacttctccagtgttacagtttctttaaaaaagaaattagtggctggacatggtggctcatgcctctaattccagcacattgtgaagctgaggtgggaggatagctttaacccaggagttcgagaccagctgggcaatgtggcaagaccccatctctacagaaaatagaaaaattagctgggtgtggtggtggcatgcacctgtggtcttagctacttgggaggctgaggcaggaggattgtttgagcccaggaggttgaggctgcagtcagctgtgttcacaccactgcacttgcacttcagcctgggtgacagagtgagacactttaaaaaaataaaaagaaattaaggtaatttcaaattggcatgcaaaggaagtcaagatttattccttttttaccatgtcaaacattatttcattcccaaattataaaatattgctgcttttcctagagggagcagtcatgattactactggatccacagatacaaaaaaaaaaaaaaaaggaaaaaacaattttgaaagcagcttaatgttgtgccttctctaaagccagcttttgacctatttatttttaatacttaaaaaatgtaagaaaggaattggatttttgcatttaaataaaaataaaagacactagatagtatagataataggaacaaataaaacaagcaattgggcctgcctttggcacttagtattttctttggttttctcagaatccagagtaatgtgtctggaaaagtacactagtaaaacattgaaacacatctctcattgtccaactcatctcatactctaccataccatttcaaatgtagtctatccatttgtggatattttcatgctgcttccatttaaatttttatttccatttttaaagaaacacacttttttgcatttttcttttttattggtgccatatagtagtttggaggcattagtcaagaattgtataaagtttccctagcatggctaataagatttagtttctgtgatcctggcagagattattatctagaattaaatgagaagattacttcaaccctatatctgaaatatccaggtaatagccttggcacttagcttgaactgtgccctctgccgctatagattaagggaagttccttctccttttttgtgtttattaaaaaggtattaatgcaaatgcttactggttaactaggttcatgaagattctgtccctccatgtttccctgaaactatgaaaggagcagggaatttggggagagactgtagttgaaaattcagctagagatcttaaagcaattcttcaagcaatgtaatgtggaccaggctgcatcctacacacctgagccttattgtagtcccttttcagcctcgtgcagcagttgccccgagttaagctgcaaagtcagtttccttctagacccaaagctcagctgcttatgcatacttttctcaaccttggtctgattgggttagattgggttaattccactctttcccaaggaggtaactctaagtactttctccctccctcccatgtctcctgcttagtctgagttccctattcctaggaggattggctcttcctcttcttttcacagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcaggtaaaaggaaaacatatcttccctgtactgagttttcagagtttgagacatgggatggtcctgtagtttgccagaagaaacaaaaaaattcccctgctttctagtgaaaacatcgggcctgtcaaggtcctagagagaagctgcctgctcttattagcttggtgcatgcctttgctgaatagtctatattgctgaacctttgctatcttttctgtttttttaaatgccagtttgtaatgtaggaggggtaagataaggaggctaaagacaactttgaaatatatcttgatcctttgtaagcatcccctgcttcctctaattttaatgcctaagaaaaaaattataggctgtgcacataaggagtagaaaaggggatggggcatgacagtcatccttcccccatttcgttgaagatgatattaaaaaaacttttagtaagatgatttaatttcccaatttcctacatatgttctgaataaggaagccttaagtgtccagttcatagtcttgatttagaagtgcctattttaaatgactactgacagtgggctggtctttctcttctttttagttgttttgcagccaggtccatcatttggaaatcaggaaggcttgtgtctcatatatgagggaaaatcaacaaacttttgagtctgtaagtagaatacatacccaggggagaactggtagagtgtgtagcaggtggaaaaataattgtgagcacctaccaaaattaaactatatcatgctgtctcctcaatagcaaatatataattcccaactggctcccttcccagtagctaacatgcttcttgagcctctgctagaattaggttgtttaggactctaattaaaaatcaagaataatctacattttcccactacttacctcgtcctacgccaagaactccagaccctaaaaagttatgttttgattgctgttttatattatccatacagttttattgaacaattaataatagttcatgaaaggtttggctctgttaatattttgcaatgcatattttaaaatacgtaaaaatgggaaccccctctattttcttgcttaatcctgtgtacaataatcttcagccagtcaatttgaggaatcttgtaaaacttaattgtaagggaacaaatgagtctaagtatctagtctttccatgtcacaaattgtataattagagctctgccactaatgattaactttaggtaaaacaacttacagaagacatatttgtacaccttcatgtatttgaattcttgttaatgaaattggaggcttccttttcttttttttttttttaaacacttctggcccttgcagtgctatttgtttcttctgtttattgtgggtattcgcctgctgttcgagttttactcctaattttctcaactggtttcagtgaattttaaaactatgtgaagacttcttgacttaaaagcttgttaccttgaagttcattgtagtcttctctacacctggggaaaggattattagtaacattacttcaaatgcaaggccatagtgtaaagcagtgcgtctcaagtatttctgtgcatacaaatcacctggagatcttgttaaaatacaggttttcattcagtaggtctgagttggggcccgagatttctttttttttttttcttaccttgagacagggtcttctctgttgcccaggctggagtgcagtggcaggatcacggctcgctgcagcctctgcctacgaggctgaagcaatcctcccacctcagcctccaaagtaacttgggactacaggcacacgccacctcactgggctaagttttttgtgtttttagtagagatggggtttcgccatgttgcccagactggtctcagactcctgggctcaagtgatctgcccgccttggcctcccaaagtgctgggactacaagtgtgagccactgcgtgcagtggagatttctgcatttttaacgaactgaagtaatgcttgctattggtttgtggacaacattttgagtaacaaagatgtgtgtaaaattttaaaactacgtaaatgaatctcaattcagtactgagtgatagaaaccagaccccatgcaaagtttatactgtttgatttcccttatataaaactctagaaaaaatacaagccaatctgtagtgacagaaagcagatcagtggttatatgtcagttatagaggggcacaagggtacttacggaagtgatacattcaccatctcaattgtgatgatgatttcatgggtgtatacataagtcaaaatttgtactatttaaattgtgcagtttattgtatgtcatttatttattttttgagatggagtcttgctctttcacccaggctggagtgcagtggcacgatctcggctcactgtaagctccgcctcctgggttcatgccattctcctgcctcagcctcccaagtagctgggactacaggtgcccgccaccatgtctggctaatttttttgtatttttagtagagatggggtttcaccatgttcgccaggatggtctcgatctcctgacctcatgatctgcctgcctcggcctcccaaagtgctgggattacaggcgtgagccacaacacccagcctgtatgtcatttatatctcaaaactttttaaaaggaaaatttaaatgattttttaaaagtctagtgatatgtatccatggaactagaaataaatctattacagtccctgagtttaatttcatttttattgaggcatattttacattcaataaaactcgtcattttaagtttaccatttttagttttggagatgatatgcaatcatggaactaccactgcagtcaagatatagaatgtttccgtcacccctaaaaggttcgcttgtcccatggtctttttagaaactaatgaaattctctttaaagttcctcagtttaattttgtaaatgcatgttttgtcaaatttgaaatccttagaaatactggtcttgcttgatttatgaaaattgtcattacttaaattggcatttcaaatgaaactcgaaagcataccatttgatgaaatgcactggtatgtggatatgccaggaccaattcctaagatacttttatactccagcttttctccactcatgacttttgtgtatgtgcaaatcttcttgaggtgctgtgcaaagtagatacttacaccataattgttgagctgagcaaaaaacgcattgcaggataatgtagaatataatcagatttcagtaatgctgtgtatttggttaagttgagtttgttttatttttgaagtatgtggagggatcttttgagaaatacctggaacggttgggagatcccaaggtaagatcaaatatgggggtttaatcttttcagagttatttggaatagtaatgtaaatttattcattcaactgtattattttagccagaccccaaatattttatttagtagccagctgtgttgaatccaatagttctcacataagtttagaggctggcaattgaccaattgttttgtgttgaatattgataattgtgtgttaatcccatcaaccatagactagcaaaagagtatacactacttggaaacaggacaagcttaagccttttcactttaacgggggaggagggtggtaatgaattttaccaagaggtcattattttgttattaaacaattcccctgatttgtagttgtcttcctcttatgtgggagtaaaattcataaattcatgctttatttagaaataatttttatgtgataaagttaattccatagttctggacttaaaaaagcacatttactaaatccctactgcctttttattatactagttccatttttattgtgtttttaaaatctctcctattaactgtccttattacttaatggctaagtagggctttagatccttctttcaggataagtttatgttaataagtagctatcacagtattccaagccttaaaacaggttatagtgtgttctacaaattcttcatctaaaacagtgctaagcagctaaaaatttgttgtgcttgaaaaaactacctcctagctacagaatgttttttaaaactcaatacactatttatgtttaggaaagtgctggccagctggaaataagagctctttctctaatttataagtaagttatatcctcttttctttgagagtgggtatgtgcatgcatgtgtgtataagatctcaacggtctcttcaggattggggaaatttgagatttgatgtattgatacctagaatgaagaaagctaagaaaaagtgttaaaatattttaaatggttgaaaagtcaaaagaagaatgtttcatgggatggaaaaattatataaaattcagatttcagtgtctgtaaagctttgttggaacacagttatgctcattcacttacgcattgtctgtggctgctttcatgctaccaaagcaaagttgaataaaccatatagtctgcaaaagctgaaatgcctattttctagccttttgccaaaaaaattgccaacctctgctttaaataaaggagagcaccatcccccaactcacagacatacatacaattgataattggttgtctttaccccttctcctcccaaattaagatacataaaaaaaaatccataggactttaggggcaattagctgtctaccttgaattaacatcatttagcccttttgggttattttaaagccaaacattaaaccggatatttatattactttatatgaataaggtaggcaacttaaaagcacaaatagttgttcctataactatctcttacgtatgccaaattatgtcttcccacttacctttgttttccccatatagtcgggatttcattctttatcgctttcctggaaaacctccaacttatgtcacagataatggctatgaagacaag

SEQ ID NO: 5843 - DNA, 79527 bp, human
cggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtgccgctgccccttagctggcttctgcccacgcccggcggggcccttctccggctacccggccactcggggttgcctgtttcctcttcccattattccggccgctcctctccctcatttcttcagctccttttccggtctgcccccgcgctctattctccgcctccgcgtcctccgcccctccttccaacggctccgcccctccgagctcgggttttccaccgggctcggcagtttttcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaagtgaggcagaacgggtagtgcctgggttccccccgagtttgcgactccttttccaaagtcttttcctgctgtggctttcgcgggactctgcgagctgggtcgcttagattcatgagtgcttgggaggttcctcgtcgggccccggaccagaaaatagttttgaaaactaagtgaaatcggccacagataggctttttggcggccgtgctccgatgttaacgtcaaactttagtagtggtggtggttcctgctctgttttacatagccagtttaaaaggccctcacattctgatttcctctttcagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcctaagaatctcagggttgggtcttttaattttaattttttttaagttctggggtattctgggggtacatgtgcaggatgtgcgggcttgttacaaaggtaaacgtgtgccatgcatcacctaggtattaagcccagcatccattagctttttatcctgatgctctccctccaataaggaactgacacttgaaccttttcgaggtaaaataaaatcgctagctgaactcactgtagccctttttgaatacacaacttatttgaatatgacaattgagaactttactggagagaacttagtattttggggtgagagaagaatgggaaattaaccactgtagtccacctttacaataaaaaaccctaaacacagaggagcaaaataatttacccggggaagtgtaataaattgtcaacttgacattagtacttgggcttagatctaaaggagtgttctgcctgctgattggttggattggtcatggagaaattggaattgtaagattgtttacatttctgttgaatgtgagtgaaatgaatccagtcaaaaataataacagctacatactgtgtaaattgtttcctcttcagaggaccgccctgatggtctagttaattagacttctagtgcattcagaagaactgcttttggggagcaatgcagttttgactgttgtgaagaaaggtgtttcgttttttcctttcttttttttttttaaagtctagtttgaggagagaaaagtctttagaaatagacattaccaacagattcgtgattaaaaatgtatctcctaggaggtaacagagcctttggcactgctctgaatgctttgtgtatattaactttacttttttaaacaatcctgtgaactaagtactgttagtatctccattttacacatgaggaaactgagacacaagagtggttaagtaatttgtccagccgggaagtggtggacagataacaatctggtgctggagtttatgttctttttttcttttcttttcctttcctttctttctatttttttttttttttttttctgggacggagtttcactctgtcacccaggctggaatgcagtgatgctatctcggctcactgcaacctccacctcccgggttcaagcgattctcctgtctcagcctccccagtagctgagattacaggtgcacactaccacgccccggctaattttttttttctttgtattttagtagagacggggtttcaccgtgttgcccaggctggtctcaaactcctgagctcaggcaatccacctgcctcggcctctcaaagtgctaggattacaggcatgatccactgcacccctccggagttaatgttgttaactaaccaccctagcataagatacccaaaaaggacttatctactcacttatcaatctccttgctctcatttaaaatagttagatgattttacatttcaaaattgaattgatcctaatattctatatttgcatattcatggagatctatccttgactatttctgggatagcacctcacatgtaaacccataagaagtggtcagggtttttcattattgatgcctgtctgtctctattgtaggcttgcttttctacttggggttgaatagaaatgaagtatagtttcacatacagtatgtcaaacctggatcttatttggattcaaggccatgcccaaagcatactccagatggcccatcgtacaatggtttcacttagagtttttcaactttatggtggtgtgaaagcaatacgcatacacattcagtagaaaccgctcttcgagtacccatataaccattctgttttacacttggagtatttaataaatggcatgagatagtcaacactttatcataaaataggttttgtgttagatgattttgcccaaccacaggctaatgtaagtgtgttctgagcatgtttaaggtaggctaggctaagctgtgatgtgtggtgggttaggtgtattaaatgcattttctatttagaatattttcaactgcttttttttttcctttttttttgaggtgagttctcactctgtcacccaagacagggtgcagtggtgcaatcatagctcacttcaagctccaactcttgggctcaagcagtccttccgcctcaggctccccagtagctgggaccacaaccaccatgccttattgtttttgtttttattttgattttttagtagagacaaggtctctctatgttgcagagagtggtcttgaactcctgggctcaagcgatcctcccacctcagcctcccaaagcgttgggattgtaggcataagccactgcacctagcctgttttcaacttatgatggggttataccccgtcacaaggctataccccatcgtaagttgagggtcattggtactagagagcaagtagcatagcactgaatcataggccataatgtcatcatcagtgataaagtaatgtatttttcaaataaagtttctagcactttttattagagagcaactgataactatactcttgtcattttgaatgtataattgaaagacctagtttgtagttctgtcaacttaagttttttaacttttgatttctagctataaagcttcgtggggaccttaacttatttcaaattgtgttgaacaaatttgatttatatttgtaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatctctgtgttgtatttctatgtgtatctgtggctgtttctttgcatatgtgaatatctgagagagtgtgtgtatgtgtgtttatttaggcgtgcatgtctccaagacactaattttggagttctaaattttgagttcattatttagattttcattattcaaggaagacaatttgctcattttagttaaaagttttgcctatagtaaatccactaaaatccctaaattatatttactctttcatttattcagttacacccaatatataaaaggcactgttttaggtgctgtggatacagtagtaaacatgagataaagtccctgttcttatggtgcttacattctagtggtggaaaattgataataagttcacaaataaatgatcaaggtatttcatgtggtgaaatgtactatgaagaaagtaagacagggtgatgtggtagctggggtgaagactgattagaattgtcagagaaggcttggcagagtacctaacattttgatctgagacccgaaatacaaggaagagccagtcatgtgaagatttggaggcagaaggaacagcaagtgcaaaagcctaagtaaggaatgaacttggagcttggtgtgtttgaggaacagagggaagattagtgttgcaggagcatagtgagcaagggaatataatagaagatgaagttgggtgggggtagcttatgtaagagttctgattttattcatgtttattgagaagccattgaagtattttaagcagagaaattatggtaaggagtattattttctacaagtatattagaattcaacaggaactgatcatcgtaatagaaggatgaagaaaattacttgtttgttttctattagttcttccttgagacactagaagcttgccaaagggccaggtcagtaattcccacttgtttgactttaaaacctatcctagtttgatgttgcaagaagtaaatgcctcatagaattactatatatgtgtatatatatatttatttacattatagtaaaatgaaattaattttaaaataaaaaacctgagaagaaactggctggagcataatttttcttttagttttactgcttctgtctcttaggcactcagtaaatacttattcattcattaaatatttattgagtaccttctatgtgccaggcattgttctaggcacttggtatacatcagtgaacaaaacaaagactcctgttcttaactgagaggaggcagattcattgattatttcaggagtgaaattgttggtgtccttatcactataatgttggagaagagggaatgtcagggtggctgtgtaacatagaagccagtcttgaactatttagtgagtcaggagagaagctagattaaagaggaataaacttatcttcctaactgctttatgcaagtcaattttttccagatacttttaattagtattttcattctaaatgttaaatcagctttgattttgtgttagtacattaaaaggaaaacactgatttcataaacatatcctgactttttactcatgctgaaaaggaaggaaactgtacaagtctccaatttattttatttttatttttttacagttttaaatgtctttttttctatattaatttcaagaaagtcacataaaagcagtaagcagtgagaaagaatcagtaattgattggttatattttcttttctttttttgagacggagtttcgctcttgttgcccaggctggagtgcaatggtgcgatctcggctcacctcaacctccacctcccaggttcaagcaattctcccgaatagctgggattacaggcatgcaccaccatgcctggcctaattttgtatatttagtagagacggggtttctccatgttggtcaggctgatctcaaactcctgaccttaggtgatccgcctgccttggcctcccaaagtgctgggattacaggcatgagccaccacacccagccaataattggttatattttcattttaggtaaatcatttattttccccagacctaggctggggggtagtatgtttgttctaatttaagcgattggtttaaataaatttccgatgtaatggttctatgtttaaaaccttatttccagcatacatggtggtgtggtatattgtttaattgtatatgaagttatgatagtaaattactggcaaagattatttcacagtcttcatgcatggtctagtagtttccccagcttattatcttgtctggcagctattacttttggtttcaatttttaaattctgttttcatgaatgaattgtgcttcagtttaaatatgcccagtcctgagaagtattacaaagccatgtgaagacatttttcatgaaatatcatttctgaaatatatcagttgacataggagataaggtatctgctgaatttatattgacattttatagtactctttgtattgctttaataatcctagtatgtatacttattaaaatatataaaaattcacatgtgcagtttttagaagtaccactatattcttggaagttagattcagtcatcagtgggcagcagatgaagtatggaattttctcccatgttacctaatatttttcttcttttgttttagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaatatatggttttaaaattgacttaacttgagcaagatacattatgaagttctttctgattagagtgtgtggtctcaagacctttacagtagattatccttaagtgtccatagctctctggtacaatgtttagatatagtttatctatcaaaatagaacattcactataaagacctctcttccattccaatcatattatcccaacatgctaaatgttccaaacattttatttggaatgcattttatcatgtttttataggtttatttttctgattgtgttttatttaggctaatattaaaaaaatgcttactagtggtagaaggtggtgacaaagaaatactctgggtagcaggaggaagccaacttggattaaaattttgctgagaataatctaaaaagtgagtaatctggttgagaattcacagcaccataatcataattgtatatcaatgttatgttttaggaaaggtcctattcaaatccagggagagaatctttagtgttttctgggccctcataaatacgtttttctcatttgagaaaattgtgactttatgttggtcacttagtttttatagtttatgatgaagaattaaagagaaacaaatgaaaggcaaggtctactcaaatatcagacaactaaaaggctatacagcccctaaatcctttgctatctacttccccagaataatgcataacctaaattccattatttcatttagcagaggtttaagccgttgttgtcaattgtgtgcagtaacgcctctgacttcccttttgtggaattttgtatcgattttggatttttaagtcaaaggagactttaaaatcattttgatttggcacggattcttgagattatctagtccaattccatcatattcagattttaccatttgcttaaagtatagcttttggcagaactgcccctaggagcagctccttgattcccagtcccctgctctttctaccctgcataatatatgttgtaagctttttgtttctttatagttgtttgcctagtgttcattttagttactcgaattccttgcaaggtaggttttgtttgtttatttatggaagttatttagtaggaatttcacacttaactgggttttcctttggcgtatgacaaccttacctaggacttagaaatctgtgatttctgagtttttggaatttaggaaaatgctctgggtaggattgatagtagattgaataaattaagactttaagacagaattgtagacttttggagttgggagataatttaaagaatattttaaaccaccagttttacagatgaggaaacatgctaaattaatcaccacatttacatcttattagtccttattaaagaatggtaaccaaaagtctgtttgaaatgtttgctctatttgtttggtttcattacatgacagagctgcaggttcttgatattaatgagtaagtggaatgcagtttatttagcagtgttctattagaggtactgaaattttcagggataaggaaatgaaagagagtttagcattgggaaatttgcaccatggatagattaagaggtagacagttaatagaacatttacgggttggagtagatgaaaagagatgtgatgttttgggatgaccttgggaattaaggattttagatacttataatttgggaggaaagaaagctcaaaggatttgttggtaagatagtataaccaatgaatttgacatagggttctggaacatttaaaagtagtcattatctgcaagtaccatcaagtatctgattttggacaccttagacctctactttttaattttaatttttttttttttgtattttagtagggacggggtttcaccgtgttgcccaggctggtcgtgaactcctgagctcaggcaatccgcccgcctcggcctcccaaagtgctggttttacaggcgtgagccactgcacccggctctactttgtattcttttaaaggcaagtcatatataggcacaaaagagtacaaaaaggttgtttgccactttaatatttagtttgaggaagtttttcaagactaagtaatgactagcagtaatataaatattcttcctggccctttattgtggtataagcacgtaattcctctgatttgttcataaatgtaaaatttgtggagatgaccaaaacacttcatatagtctgagaaatgacacatggacagatcatttgaaattaattttggggaaacatttggaaagggtcatcatgatagccatgtggtgatcaattttctgctgtacatgtaataccatttatttatttatttatttatttattttgagaccaagtctcgctctgtcacccagactggagtgcaatggcgtgatctcggctcagtgcaacctccacctcccagtttcaagtgattctcctgtctctgcctcccgagtagttgggattacaggcatgtgtcaccccgtggggctaatttttgtatttttagtagagactgggtttcaccatgttggccaggctagtctcaaactcctgacctcaggtgatcctcccaccttggcctccaaaagtgctgggattacaggcgtgagccaccacacccggccgtaatacgatatttttattggggagtggggagtgaaaaataattttggttaacactagtgcttagtatgtatcaggtactattcagagcactttacacatatatactcatttaatctttaaatattcctgtgcaataattggtattgtccattctacaaataacataatgtgaaaaaagttgtatttcattttagggtccaagagatgttgtggaaattgtaatttgaacactgaattccagtatacttccatcctttatggggacagtaggagagaatatttgaaatcagaggattttcctaagaaatttagattgtatgttagccacaggcgtaacggtatgctagccataggtgtataacctttttgaatttttacattgctacttaaaaaaccacagtgatggctactcatagaatccatgtgtagaatccatgtggagaaactctttcaattggtttacctgattgcaagttatttacaaatctttttcttttttcttagttgtattttaaagtttcattttggtccttgctttatttcttttcttggaattttcagcattcccacagcttctactgttgactcctttatctgtatctcccaactctgatttgggctcctaaatgatatttccaattgcctttggccctgtctgtctgttaattctgtaagcacctcaaactcaaggtgtgccccaaactgaaatcatatttcttttcattcttctgaggtgcttatctttattaatggtatcatcatttagtcattcttctagcctttaactctgtctccaaccccttatatctaattggtttccaagcactcacagctttatttcctaagtacctcaagcttatgtattcatcattcaggcttttaatataaatgcataatgagaatctaccttttgtatcagcaggatccaagacatgattcctgctctgaaggacctatgtcttactcatttttgagtcctttgcctgaaacacagtaggctttccataaatgatgaatgcacttctgtaacctagtactcttttttgattgtcttgattaggattaggtattgttctaggaaacactgtcatcttgtacacatttatttcatactgactttgatttgacagcgaagtatctagtaagtctcttgttcagaagatgtgaccatcatattgtatggtaagtttgtaggatcaagcacatataagaatagcatcccaaatataacagtgctgattctatgcagtatcttaatggtatttaagggtctgtcaaataatggtacctgtcagggatttgtggcaaaacatgatgttaaaaatcaggtatatgaaaagcactatagtgttttctagtaaaagcttacatagagaaaggtttaggatattaccaaacaattttttttttcctttgagacagggtctctctgtcaccgaggctggagtgcagtggcaagatattggctcctctgcctcccctggtcaagtgaccctcccacctcagcctctggagtagctggaaccacaggcatgggccactacacctggctaattttttgtagagacggggttttgccatgttgcgcaggctggtcttgaactcctgggctcaagtgatctgcctgcctcagcctcccaaagtgctgggattacaggcgtgagccactgtgcccagtcatcaaatgatatttaattacttattaagtggctaatggctaattccctacgtgaatgctctatttattatacagtttttaattcttttttttttttttttttttttggtaggcggctaaacaaaaggtagacaaatctggctaggttcaaacaggaatgtagaatacatgatgctatttattttttttttttttaacggagtctcgctctgttgcccaggctggagtgcagtggcattatctccgctcactgcaacctccgcttcccaggttcaagtgattcaccctcctgagtagctgggattacaggtatccaccactacatctggctaatttttgtatttttagtagagacggggttttgccatgttggccaggctggtcttaaactcctggcctcaagcgatccacccacctcggcctcctaaagtgctgggattacaggcatgaggcactgtgcccggccagaatacatgcttcttaatgttgatactgattcttgaaaaatattttgacaggcttttaataccattatataccatctatgttggtatttctatatcttcattgtcttataaattttttaccatattctggccaaaattacttattttgattgacacttgtatcatagctttgaacatgattttattttggtggctgcagtcctgttctctgaggcagtggttcttaagcttctttcagccatggaactctttaatttaaaactgtggcttttcttctctatatacatgattttgcagtgactttcagaaagtttgcaggacctcatggccccgggttaagaatccctaggctgaggcgaacttcagtaacttcatttcttggtcattgtttattactattttggtcttaattcctagactcatttgtaattaaacccttttgattaattacatttaaatttagtaattcccagtttttatttttatttctatttttatttatttattttttttttgagacaaagtctcgctctgtcgcccaggctggagtgcagtggcgcggtctctgctcactgcaagctccgcctctcgggttcacgccattcttctgcctcagcctccggagtagctgggactacaggcgcccaccaccatgcccagctaattttttttgtatttttggtagagacagggtttcaccatgttagccaggatggtctcgatctcctgacctcgtgatccacccgcctcagcctcccaaagtgctgggattacaggcatgagccaccactcccggccagtaattcccagtttttataatgtaacacaaattcaatactttttttgtttaaagcatactagccaatacatttttgaaactaaccttaatattcttatgctattaactcagtatctgtaacccataatgtcatatagtgtcttttctaatagataataaggactaaatggaattttttatttgtagtaattattttagaatatcctataatagactggtgaagaaatccagtaaggcaatacaatatggtgtttactcatggttaagtgtgctactaaagtacttggttgcaggaccctgatagtcactgttggaatgatgtctatgagacgcatatagtacatctttttgaatgatcatttctccttttgtgcagcattacatactggtcaattctccactgccagtgtgaagtgaggggataatacactccccatatttagtaatgaaaaacattcctaagtccttagcctaaattagtagttttctggatctcagttttcctgtttgtgaattaataaaactaacttctcgggtgatttctaagacataaacctagttgtgtggcatgttttaaaaattaaaaatgctgttgaaataacacattttctcttggttagtttttgttttgagaagtaggactaagatctatttttagaattcacagaatatagtcctaaatgatacggaaagcagatttttcattgaatttcatgtttaaactcatactcagtttctaattggggttatagttagataatttaagtttatttagaagtttaattgaatgagtctttccagtgcttcaaatgttctgggttttttccctccttctgctaatcctgtctctagactgatcagacactgcaggtatcttaagtcaaaaaacaaccttctgctgggcgcgggggctcatgcctgtaatcccagcactttgggaggccaaggcaggtggttcagctgaggtcgggagcttgagaccagcctgaccagcatggagaaaccccgtctctactaaaaatacaaaactagcccggcttggtggcacatgcctgtaatcccagtcgctcaggaggctgaggcaggataattgcttgaacctgggaggcagaggttgcagtgagccaagattgcgccattgcactccagtctgggcaacaagagcgaaactctgtttaaaaaaaaaaaaaaaacaaaccctcagtgtttgtgtgccagtgtggtatattttaaagcaaagtaatattttcctttaaaaaaaaatctgtattgtcatgctatcaggtggaaatggggaagagaagaaaatgaaagcaagtggttcttgataatattttattttgcaattccgaagaaggattacttctttgggaaatccattctttgtcttgcctttatttctccttcctaaaacttgaggaggaggttgaacagggctgccaggccatgctttgttttagaaccattgtgttcccttccttcataaatcttgctttgctaattctgcttgaatgttcaccctgaaaagttgataggctctagttccagggtgctgttaaaatacatttttaaaacacattaccattatattttcagtaatgaaagaccctaaaaagaggttctgtagagttatttcccttaatttgcttcatgttatttggtactaaaaataattgaagtaagttatttagggctaatttttaaaatactggcttttcagtaggttctgttacaagttgttatatgttaatacatgggtttgttatctttaaaaatctaggtctgtttatgtggtaatgtcagatttattcatttttatgtgggccagtcatccccactttttgccaagataataggctaacacccaaaagctatttttaatattgatcacaaatttgaccacttaaaggaaggtgttatcaatattttaatattgattacaaattttaccacctaaagtctgttatccactgttgaatcacagagtaattccctacatttggaagagtgcttagagattatgcagcccatctacttattttacagatgaggaaactgagacttaaagtggtacagccaagttcataacattcttttcatgataccatattgcctctcagaaactaataactcatagcattttgtcatacacatttacaactataccttgtatgtcacaggtaatgtatgctttaaaaaaataattccggacatacctcatttaattggttgaaacgtgaagtgttattttagaattaaaatcattagtatttatatgtcacactacagtttccttgtttatcagtgaagaaataaatatagcaattaaaagggcaaattacgtattctagctaaatttcagtataaaaagtagtcattgcaaaattaaagcccatcagtttcatgacaagtaaactatgttatttaaagttactttaatgttttttcaacttattttaatctgtacccagagatacagtgcttaaaacttaaaatgtcttttttaagacattttctttccattatacttagatgtcaaagggaataattccattagggatggggaaacaggatatggacccatattagaactttgatttccagtagaatttcagtgaaattgctctggttcttacctttttttttttttttttttttggaccaaagaatgattgcttgctgaatgttttgtcaggtagcagctaacagccatccatatttaagcacgaacgtgctaaacactgaatatacagtgtcttttgtattattctaacaaccttaggtttaagtcacaaaaatttctagagcagtgtttctcaaactttgaaacattaataggtgatctatggagggaagaaggtgtttgataaaggctaggtcaaaaatgtgaagcatttactataagcattccttaggacctttaatgttgctaatgggcactgtgaatctcaaggataggattataatatgcaaagtttgctgaaattttggccttgaaattctctttttaggaatatgttgttctagagcagtggttttcaaagtgtattccctggaccagcatcatcatcacctgggaacttgttagaaatgcaaattcttgggattcatcccagacctgcctcagaatcccttgggcaagaggcaatcttttaacaagccctccacttgagaaccactgttctggaagtttttcaggactaaagtagtttgctgtggagaaagccaattgggatttcaagtgcgatatttcaaaggacagtattaaataccttgaagtggctttttattatatgcaagacaaagtctagaatcgacccacagttctctttaaaatatcctattgtactaatctgcagaatggaacctctgctttaccacttctgggcttttgttcatgttttttctgccttggtatgtaattcctctttatggtaattgtgcaaacatcaggagattttatatagttttagtttcagtactgttactgattggatgtgaaaacttaggtaggtcttaaaactatttcagacctgtttcttcatctgtaaagtaagagatcccttggagctgtaaaattccaattacttgttttcccagtttatgatgctattgtttcttgctcactaatgataaaatgtttaaatttgctttctaaaattaaggtaatacatgtgaatagttaaaaatgttaattgattatacaaggcttacaacaagaaacagcagttgtatgtcctattcctccgcatctctgttcctgcttcttatagatgaccgtattactttatgttttataaataatatgcttaaactggttttgttttgttttttaaatttgaatatcattgtaaccttcctacatggaagaggagacttttcaaaaattaatgtttttaatttacacgtcacaattgtatatgcatttatagggtacaatgtaatgttttgctatttgtgtacaatgtggaatgattatgtcaagctaattaacatattcacctcacttacctatcattttttatggtgagaaatttgaaattcttattttgaagtacacaatatattattattgactgtagcgactctgctgtacaaaagatcccagaacttatgtcctctgtctgtctgaagctttgtaccctttgatcaacaactcccattttctcttttcccactcaccccccagcttctggtaaccatcattctaactctctacttctatgagttcaacttatttagattccgcatgtaaatcatgccctctttgtctttctgtgcctggcttatttcacttagcatataacgtcctctaggttcatctatgttgtcacaaatgacagaatttcgtttttctaaacactgaatagcattccattttgtatatgtaccacattttctttatccattcatccactgatggacacttaggttgtttccttatcttgggtactgtgaataattctgtaatgaacacgggagtgcaggtatcccctgacatactgattttatttcctttggatatatacccagaagtagaattactagatcatatggtagttctatttaattttttgaggaacttccatactgttttctataatggctgtactaatttacattcccaccaacaacgtacaacagttttcttttctctgcatccttgccaacacttgttatctttcatcattttaaataaaaaccattctaacagttgtgaggtgataatctcatgttttgatttgcatttctctaatgattagtgatgctgagcattttttcatgtacttgtttgccatttttatgtcgtcttttgagaaatgttcgtttagttcctttgctcatttttaaattgggttgttttcttgcttgttgagttgtttgatttccttacaggttttttttttcgagttatttgatttccttacatatttggatattaaccccttatcagatgtatagtttacagatattttctcaatttctgtgagttgtctcttcactttgttaatagtttcctttgctgtgcagcagctttttagtttggtgccataccatttgtctatttttgcttttgttacctgtgcttacagggtcatattcaaagaatcattgcccaaagaagtgtggagcttttcccctatgttttcttctagtagttttgcagtttcaggttttatatttaagttttcaatccattttgagttgattttttaatatgatgtaaggtaaggatccaacttcattcttctgcccgtggatagtcagttttcccaaccccatttattgacaagactgtcttttccccattgtgcattcttaatacctttgttgaaaattgaccataaatgtttaggtttctttctgggctttctatcctgttcctttttttgatgtgtctgtttttataccagcatgatgctgttttgattatgctcactttatatatgatttgaagttagggagtgagatgctgccagctttgttctttttactgaagattattttgtctatttgggatcttccgtggttctatataaatttaaggatttttttttttctatttcggcaaaaatgtcattggaattttgatagagattgcattgaatctgtggatcactttggtagtgtggacattttcacaatattcttccaatccataaacatgggatattgttccgtttatttgtgggttttttttttttttttcagtttttttcatgagtgttttatagttttcagtgttatatcagtcttttacctcattggttacatttatacctaagtatttgttgctattgctattgtaaatgggattgttgtcttaattttctctttggataatgtagaaacactactgattttttatatgttgattttgtatccttcaactttactcatttttttaatcagttctaaccattttttggtgtagtttttaggtttttctatatgtaagagcatgttatcagcaaataaagataatttcatttcttccttttctagtaggatgtgttttctttctcttgcctaattgctctggctacgatttgtatgttgaatagaagtggtgagagggggcatccttgtcttgtccctgatctcagaggaaaagctttcgatttttcactcttgaaaatggtcatagctatgggtttatcatatgtggtgtttattgtactgatatacatttcctgtatacctaatctgttgagaggtgtttttttttgtttttttttgtttttttttgagatggagtctcaccctgtcatccaggctggagtgcaatggcgtgatctcggctcactgcaatctccgcctcccaggttcaaacgattcacctgcctcagcctgctgagtagctgggattacaggcgcccgccaccatgcccagctaatttttgtatttttttttttttttttttttagtagagatgcggtttcactatgttggccaggctggtattgaactcctgacctcgtgatctgcccgccttggcctcccaaagtgctgggattacaggtgtgagccaccgtgcccggccaagagtgtttttgtttgtttgttttttcattatgaaggggtgttgaatcttgtcagatgctttctctgcatctatttaaatgatcatgatttttattcattctgttaatgtggtgtatcacatttgttgatttgtgtatattgaaccttccttgcagccccaggataaatcccacttgagcatggggaatgagtcttgtaatgtgttgtggaatatagcttgctagggttttgttgacgacttgcatttatgttcatcagggatattggtctgtaaatttctatttttgtagtgtccttgtctggctttggtatcagggtaatgctggtcttgtaaaatgagtttagaaatattccttctttttcagttttttgaaagagcttaagaaggattggtactggttctttaaatgtttggtagaattcagcagtgaagccatggggtcttggactttggtgggagacttttattattgattcaatctccttcctcattattggtctgttcagattttctatttcttcatgatttagtcttggtaggttgtatgtgtctaggaactcatccatttcttctagactatccaatttgttggcgtataattgtttatagtagtttcttgtgatcctttgtatttctgtgataacagttgtaatgtctcctattccatttctgatttgagtctttttctcctagtctagctaagggtaggtcaattttgtttatcttttcaaggaactaactcttagtttcgtttattatttttctatcatttttctagtctctttcatttatttatgctctgatctttgtttccttccttctgctaactttaggttgttctttttctagttccttgaagtatgttagattatttgagatctttcttcctttttagtgtaggcatttaccactataaatttccctcttagaactgtttttgttacatcctgtaagtttttgtatgttgtgtttccattttcatttgtctcaagggttttttttaatttcctttttgatttattctgtgacacattgacttgttcagaagcattttgtctaattcccacatatttgtgtgtttttcaagattctttctgttactgatttatagtttcatgccattgtgatctgaaaagatgcttgatatgatttcaatttccttaaatttgttaagacttgttttttagcctaacaatgtgatctatcctggagaatggtccatgtgtgcatagcaagaatgtgtattctgttgctgttggattgaatattctgtatatgtctgttaggtccatttggtgtaaagtataattcaagtctaatgtttcctaattgattttctgtctaggttatctgtccattgttgaaagaggggtaatgagatcccaaagaggagactttttcttttttctcttccccattttccttcctatcctcctaatttagttttatcagttctgtgagattcattttcaatgttgacattattatgactgcttaactacggtattattcacatctgagccatgtagtgttcaatgattttatttcctttcctgtaaaactttgttttatctcattttgttatttcatcattttcccactttttgatagtaacatctccaaactttccaacagaagtgtacatctctcattatattcaaacacatcgggttatctaaacctttattatcttttttgagatatccacactggagttctctgtcctatttttggaaatgcttattttctagtccttctgagtgtctatcttcctgcgatttccccttcatccttatcctgtaatttctctttgcttttctcttgtgttgaatctcctatttccaagattgctcccttccacccccagactttaaaaaaaaaattctttattttggtttcacatatcttcagtagcttttctgagaaagggtggcaacatttttgaatctttttttttttctaaaaacaccttgttttactctttcatttgatagcttgcaatagaaataaaggttggaaataacttcccctctaatctagagcttcattgttttccgaatcctagtttttcttttgagaagtatattgtgttcttatttgtgttcttttgtgtataaactgttcttcttctgtgaaagctttaggatcttctctttatcccctgacttcagaaactttattgttatgtccagggatgatcttttttgctttcattgttgtggctgcttcatgggccctttcagtctcaatatggatactcatgttctacagtgctagaatttttttatattgtcatcatcatcatcatcatcatcatcatcattatcatttctttccctctgctttcctcatttcacttcgggcttcctgttggttagatgttggctttcctagattaataatctaattttcttattttttcttcccaatattgttgactattctgtgagctcctcaactctgttatttcttctgcttttttgttttacttaactgttaaatttaaatacagtaaaattggcctgttttcttatatagttctataattttgacaaacgcgtaatcatgtaaccactaccacagtcgagatgcagaacagttccagtgcccccatttatcctttctctttgtagtcagcccttcaaccctaactactggcaaaaactaatctgttttcctttcctatagtttggcctttttcaatgtcatataaatgcaggcatacagtgtgtagccttttgactcatgtctttttttgcttcgcatgttacatttgagatacgtgttcttttatgtatcaatatttcattattttctattcctaggaagtattctattgtttgaatgtaccacagtttttgtccattcaccagctgaaaaatgtttagattgtttccagttttgagagctcatgattatggataaagctactataaacattcacatagaggttttggtgttaccatttctcttatgtagttacctagaagtgggattgcttgatcatatggtaattctgttcaattttataagaaactgttaaactattttccacagtggttgtactattttacattcccactagcaacgtatgagagttccagttctatatccttttcaacacttggtattgtcagttaaaaaaattattttagttagtatgcagtagtatctcattaaagacacacaaatggccaataagcagatgaaaagatgctcaatatcattagccactggggaaatgcaaatcaaaaccacagtgagataccacttcacacccaccaggtttactataatcaaaagatggaaaataacaagtgttgataagaatctagagaaaatggaaccctcatacactattggtaagaatgtaaaatggtgcagttgctctgaaaaacagttcctaacattaggttaaatagagttaccatatgatccagtaactccactcctaggtatatacctaagataattgaaaacataagtctaaacaaaaacttgcatgtgaatatttatggaaatattattcataatagcccaaaagtggaaacaacccaaatttctatcaactaatgaatggataaacaaattttggtttatgcaggggattgaactatgtagtgatgcaccatgctccaacatgggtggactttgaaaaccttatgctaagtaaaagaagcgagtgacacaagaccacatactttatgatcccatttgtttgaaatgttcagaatatggaaatctatagattcaggaagtagattagtggttgtctggggttggtggggatagagggattagaggttgacagctacaggatgcagagttttattttgggataaagagaatgttctaaagttgattatggtgatggatgcacaactctatacaacaaaccattgaattgtatactttaagtgggtgaattatatggtatgtgacatatctgaaagctgttaaatttaccagttttaagagtacaatttaatttttagtgaatatacagaattgtgcacatatcaccacaaaatagttttagaagatttttattattccagaaagattctttgtgcttatttgtagtcaatgcctatttccactccagccccgggcaaccacttcatctgctttctgtctctagatttacccttttggcatatttcatataaatggaatcatattccttttgaaatcatacagtttttgcttccatcttcttaggaccagtttctccaatccttgttaatgcttgttactgtctgtattgtttattacagctatcctggtaggtatgtaatgatgtcttattgtggttctaattttcattttcctaaagatcaatgattttgaatatctttttatgtgctcattagtcattcttatatctttggtgaaatgtgtattcaaatcttttgtctatttaagaaattggattttttttattgttgacttttcagagttctttatatattttggtacaaagtttttctggttagatatgtgatgtaaaaatattttattccagtctatggcttgtattttcattctcctaacaatgtcatttgcagagcaaaagtttttaattttgataaaatcgagttaatttttttttctattatgtatctgagaactcactgcctaacccaggatcttaaagattttctcctatgttttattttttaaaattttgaagttttattttacatttataccactttgagttaattatagtacaaggtgtgaggtataggttgaggatccttttttttgcatgtggatggtcaattgttctggcaccacttgatgaaaatgctatcttttttctattcaactgattttgcacctttgtcaaaaatcaatggaccatatttgtgtggatctacttctgtgtgcttccctgtgtgttaacttttctcttgctctgtctccttttgtcttcctgtccctacttgtgtttttttttcagttttctattacttttctgattctctccctccttctcctgattttcccttcccccattcccttcctcaaaatgaagcatttagattgcattgttttatatatcatacttatttttagtttaaaaagcagatgtgaagcatttgtgtttttctttacaagtacaatatgctggaaacaaattaacttttaaattataatccctttttttttttttgagacggagtctcgctctgttgcccaggctggagtgcagtggtgtgatctcggctcatgccattctcctgcctcagcctcccaagtagctgggactacaggcgcccaccaccacgcccagctaattttttgtatttttagtagagatggggtttcaccgtgttaggcaggatagtctcgatctcctgacctcgtgatctgcctgccttggcctcccaaagggctgggatcacaggcgtgagccattgtgcctgaccaaattataacccttaattaatttttctcagtgaattagtgaccttaacgaaagatggcaatctctcttcccaaactgtgtgtttcagaacttctgcaaaaggcatcacttctccagtgttacagtttctttaaaaaagaaattagtggctggacatggtggctcatgcctctaattccagcacattgtgaagctgaggtgggaggatagctttaacccaggagttcgagaccagctgggcaatgtggcaagaccccatctctacagaaaatagaaaaattagctgggtgtggtggtggcatgcacctgtggtcttagctacttgggaggctgaggcaggaggattgtttgagcccaggaggttgaggctgcagtcagctgtgttcacaccactgcacttgcacttcagcctgggtgacagagtgagacactttaaaaaaataaaaagaaattaaggtaatttcaaattggcatgcaaaggaagtcaagatttattccttttttaccatgtcaaacattatttcattcccaaattataaaatattgctgcttttcctagagggagcagtcatgattactactggatccacagatacaaaaaaaaaaaaaaaaggaaaaaacaattttgaaagcagcttaatgttgtgccttctctaaagccagcttttgacctatttatttttaatacttaaaaaatgtaagaaaggaattggatttttgcatttaaataaaaataaaagacactagatagtatagataataggaacaaataaaacaagcaattgggcctgcctttggcacttagtattttctttggttttctcagaatccagagtaatgtgtctggaaaagtacactagtaaaacattgaaacacatctctcattgtccaactcatctcatactctaccataccatttcaaatgtagtctatccatttgtggatattttcatgctgcttccatttaaatttttatttccatttttaaagaaacacacttttttgcatttttcttttttattggtgccatatagtagtttggaggcattagtcaagaattgtataaagtttccctagcatggctaataagatttagtttctgtgatcctggcagagattattatctagaattaaatgagaagattacttcaaccctatatctgaaatatccaggtaatagccttggcacttagcttgaactgtgccctctgccgctatagattaagggaagttccttctccttttttgtgtttattaaaaaggtattaatgcaaatgcttactggttaactaggttcatgaagattctgtccctccatgtttccctgaaactatgaaaggagcagggaatttggggagagactgtagttgaaaattcagctagagatcttaaagcaattcttcaagcaatgtaatgtggaccaggctgcatcctacacacctgagccttattgtagtcccttttcagcctcgtgcagcagttgccccgagttaagctgcaaagtcagtttccttctagacccaaagctcagctgcttatgcatacttttctcaaccttggtctgattgggttagattgggttaattccactctttcccaaggaggtaactctaagtactttctccctccctcccatgtctcctgcttagtctgagttccctattcctaggaggattggctcttcctcttcttttcacagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcaggtaaaaggaaaacatatcttccctgtactgagttttcagagtttgagacatgggatggtcctgtagtttgccagaagaaacaaaaaaattcccctgctttctagtgaaaacatcgggcctgtcaaggtcctagagagaagctgcctgctcttattagcttggtgcatgcctttgctgaatagtctatattgctgaacctttgctatcttttctgtttttttaaatgccagtttgtaatgtaggaggggtaagataaggaggctaaagacaactttgaaatatatcttgatcctttgtaagcatcccctgcttcctctaattttaatgcctaagaaaaaaattataggctgtgcacataaggagtagaaaaggggatggggcatgacagtcatccttcccccatttcgttgaagatgatattaaaaaaacttttagtaagatgatttaatttcccaatttcctacatatgttctgaataaggaagccttaagtgtccagttcatagtcttgatttagaagtgcctattttaaatgactactgacagtgggctggtctttctcttctttttagttgttttgcagccaggtccatcatttggaaatcaggaaggcttgtgtctcatatatgagggaaaatcaacaaacttttgagtctgtaagtagaatacatacccaggggagaactggtagagtgtgtagcaggtggaaaaataattgtgagcacctaccaaaattaaactatatcatgctgtctcctcaatagcaaatatataattcccaactggctcccttcccagtagctaacatgcttcttgagcctctgctagaattaggttgtttaggactctaattaaaaatcaagaataatctacattttcccactacttacctcgtcctacgccaagaactccagaccctaaaaagttatgttttgattgctgttttatattatccatacagttttattgaacaattaataatagttcatgaaaggtttggctctgttaatattttgcaatgcatattttaaaatacgtaaaaatgggaaccccctctattttcttgcttaatcctgtgtacaataatcttcagccagtcaatttgaggaatcttgtaaaacttaattgtaagggaacaaatgagtctaagtatctagtctttccatgtcacaaattgtataattagagctctgccactaatgattaactttaggtaaaacaacttacagaagacatatttgtacaccttcatgtatttgaattcttgttaatgaaattggaggcttccttttcttttttttttttttaaacacttctggcccttgcagtgctatttgtttcttctgtttattgtgggtattcgcctgctgttcgagttttactcctaattttctcaactggtttcagtgaattttaaaactatgtgaagacttcttgacttaaaagcttgttaccttgaagttcattgtagtcttctctacacctggggaaaggattattagtaacattacttcaaatgcaaggccatagtgtaaagcagtgcgtctcaagtatttctgtgcatacaaatcacctggagatcttgttaaaatacaggttttcattcagtaggtctgagttggggcccgagatttctttttttttttttcttaccttgagacagggtcttctctgttgcccaggctggagtgcagtggcaggatcacggctcgctgcagcctctgcctacgaggctgaagcaatcctcccacctcagcctccaaagtaacttgggactacaggcacacgccacctcactgggctaagttttttgtgtttttagtagagatggggtttcgccatgttgcccagactggtctcagactcctgggctcaagtgatctgcccgccttggcctcccaaagtgctgggactacaagtgtgagccactgcgtgcagtggagatttctgcatttttaacgaactgaagtaatgcttgctattggtttgtggacaacattttgagtaacaaagatgtgtgtaaaattttaaaactacgtaaatgaatctcaattcagtactgagtgatagaaaccagaccccatgcaaagtttatactgtttgatttcccttatataaaactctagaaaaaatacaagccaatctgtagtgacagaaagcagatcagtggttatatgtcagttatagaggggcacaagggtacttacggaagtgatacattcaccatctcaattgtgatgatgatttcatgggtgtatacataagtcaaaatttgtactatttaaattgtgcagtttattgtatgtcatttatttattttttgagatggagtcttgctctttcacccaggctggagtgcagtggcacgatctcggctcactgtaagctccgcctcctgggttcatgccattctcctgcctcagcctcccaagtagctgggactacaggtgcccgccaccatgtctggctaatttttttgtatttttagtagagatggggtttcaccatgttcgccaggatggtctcgatctcctgacctcatgatctgcctgcctcggcctcccaaagtgctgggattacaggcgtgagccacaacacccagcctgtatgtcatttatatctcaaaactttttaaaaggaaaatttaaatgattttttaaaagtctagtgatatgtatccatggaactagaaataaatctattacagtccctgagtttaatttcatttttattgaggcatattttacattcaataaaactcgtcattttaagtttaccatttttagttttggagatgatatgcaatcatggaactaccactgcagtcaagatatagaatgtttccgtcacccctaaaaggttcgcttgtcccatggtctttttagaaactaatgaaattctctttaaagttcctcagtttaattttgtaaatgcatgttttgtcaaatttgaaatccttagaaatactggtcttgcttgatttatgaaaattgtcattacttaaattggcatttcaaatgaaactcgaaagcataccatttgatgaaatgcactggtatgtggatatgccaggaccaattcctaagatacttttatactccagcttttctccactcatgacttttgtgtatgtgcaaatcttcttgaggtgctgtgcaaagtagatacttacaccataattgttgagctgagcaaaaaacgcattgcaggataatgtagaatataatcagatttcagtaatgctgtgtatttggttaagttgagtttgttttatttttgaagtatgtggagggatcttttgagaaatacctggaacggttgggagatcccaaggtaagatcaaatatgggggtttaatcttttcagagttatttggaatagtaatgtaaatttattcattcaactgtattattttagccagaccccaaatattttatttagtagccagctgtgttgaatccaatagttctcacataagtttagaggctggcaattgaccaattgttttgtgttgaatattgataattgtgtgttaatcccatcaaccatagactagcaaaagagtatacactacttggaaacaggacaagcttaagccttttcactttaacgggggaggagggtggtaatgaattttaccaagaggtcattattttgttattaaacaattcccctgatttgtagttgtcttcctcttatgtgggagtaaaattcataaattcatgctttatttagaaataatttttatgtgataaagttaattccatagttctggacttaaaaaagcacatttactaaatccctactgcctttttattatactagttccatttttattgtgtttttaaaatctctcctattaactgtccttattacttaatggctaagtagggctttagatccttctttcaggataagtttatgttaataagtagctatcacagtattccaagccttaaaacaggttatagtgtgttctacaaattcttcatctaaaacagtgctaagcagctaaaaatttgttgtgcttgaaaaaactacctcctagctacagaatgttttttaaaactcaatacactatttatgtttaggaaagtgctggccagctggaaataagagctctttctctaatttataagtaagttatatcctcttttctttgagagtgggtatgtgcatgcatgtgtgtataagatctcaacggtctcttcaggattggggaaatttgagatttgatgtattgatacctagaatgaagaaagctaagaaaaagtgttaaaatattttaaatggttgaaaagtcaaaagaagaatgtttcatgggatggaaaaattatataaaattcagatttcagtgtctgtaaagctttgttggaacacagttatgctcattcacttacgcattgtctgtggctgctttcatgctaccaaagcaaagttgaataaaccatatagtctgcaaaagctgaaatgcctattttctagccttttgccaaaaaaattgccaacctctgctttaaataaaggagagcaccatcccccaactcacagacatacatacaattgataattggttgtctttaccccttctcctcccaaattaagatacataaaaaaaaatccataggactttaggggcaattagctgtctaccttgaattaacatcatttagcccttttgggttattttaaagccaaacattaaaccggatatttatattactttatatgaataaggtaggcaacttaaaagcacaaatagttgttcctataactatctcttacgtatgccaaattatgtcttcccacttacctttgttttccccatatagtcgggatttcattctttatcgctttcctggaaaacctccaacttatgtcacagataatggctatgaagacaaggtaagaagatgagtgaatgttgacttatataaaagaagttgaatgatgcttctggcttgcctggatattaaatcatttttaacctaattaatgaaaagcatagtctgaatgacaggtttctctgttactagcattttcctctctagtcagttaatctcagtgttgttagccctctaaacagacctgatcgtcatttctctgtgataggaaaaaagccaccccaaaccctaattggcttctcaatgactaaaaaggataaggttcaaactttgaagctaggcattcagcatcctgaaaggtcccaaaccagcttcattttcttccatccttattatgccatgcttccaggtattctgcttttcatactttgtgtctttgtatttgaaactttcccaatgcccctggagtcattttctcactttgtgctcccttagcagctcccaagtaattgtagtgtttattatattgtgtttgttttcatatgtatttctttcattatctgaaagtttcttgagggaagtgacagtgtctactactgcctggtaaagtacttgattgttagttgagaatactcagcagataaattgtttgtcagcatacagcttctccaaaaagtttataaaagaaaagccctttatcctgattattttattagtgaaatatagactacacaatgtttgagttctatatgtcttatttcacaacatggaacacaatttagacacaattctaatgatggcatgacaagactggagaccaggagaactgttaggatgctgttacgataatcgagggtgaatacctgaactaaggagaagtagcattaggaatagagaagactgaataggagataacttagaagataagtatgaacggggtacgttaattatctcttttctgagctttggggacaccaaaatgaatacagtgaaatccttgccctccaagagcttaagggacaatgaagacagacctgcaaagggttaattacagcaaagtggtaagttttataataaaaaaaattgtgctaaaagcataagggaaaaagcccttctttctgcttgagggagtttagaaagcttcatggtggtagtgacatttaagtggagtataaaagagtccatcaaatatgaagagcagtctattcagaggaaacactatatacagaggcatagaagcaagagaccctttgggagttaagtagttggatgtgaggaggatgatgctggaaagatagtctagagttacatagtaagaggtagagcaggccatgccaaataatttgtcttttcattgtacagaatagtcatttgaaactttttcccaacgttttattatgatgttcaaacatacagaaaagttaaaagaattttacagtgagcatccatatacctacccaccacctagagtctgctgttaacatcttagtattcttatcacatatctattcctcgatccattcatctgtccatctttcttttttgatatattttaaagtaaatttcagacaccagaaaacttgaccctaaatgctaatggaaagtttttaggcaaaggtgtgacataatctgaattgtttgaggaagaggagtgttaacttttgtatctaagcagttgtacatagcattgcttgagatgaaatttggatctttaccagggatctttaaactcccagttcagtttttcctcaacattgtattctgaaatttttcatacagagagaagtatgaagactcatgcagtaaacattcatgtacccaccacttagttcctacaattacacagttccatttataaatgtcttgtgtatcttacagagagattatttagctaatttagggggaacgttacccattgggaaccatgagaatacaaaaatttcagaccttttgagtgtgtacaacctacaaatatccatacatgtatacagagctaatacttaccagcacttgggtattttcatgtacaggatagtgcatatatatgtctgatttgggaatttatgaagtgggagtgtgtgtttatattgaaaagccaggtgcttttattttgtgatgctttgctttgcctaaaactttgttgctttatctcagttcacactcctaagattggcatcaggattgaatttttaaaaatgaggccgggtgtggtggctaatgcctgtaatcccagcactttgggaggtcgaggtgggtggatcacttgaggtcaggagtttgagaccagcccggccaatatggtgaaaccccgtgtctattaaaaatacccaaattagctgggtgtggtggcgcatgcctgtaatcccagctacttgggaggctgaggcagaagaatcacttgagcccaggaggcggaggttgcagtgagccaagattgcgccgctgcactccagcctgggcgacagagcaagactccatctcagaaataaataaataaaaatgattgtattataggcagtgaacattattaatgagccttctaaaaatattttagaacaaactttcatagaaataaatgtctaatattcactttggcatctttcatcttgtgtgttgacttaattctgcattctacatagttatcttcagtttcttaagtgtattcagctgaaatcgagccatcttcactcagctcatttgctctatctagatagaagtacatacttacattaaaaagaaaataaaattaagtcttgaaatgtagagtaagaaagtccccactcatcctcttcaattttatgcccttcaaagtaacaagtattggttctcatgcacttcaaagtaacaaactattaagtattggtgagtatctttctgtatcattttatttgtgtttgtcttttaaatgtaaatgggcccatatttaacattgttacttgttctttttaaatatccttcttagtaatatagatctaccccattttttcactagtttactgccattaattacatcccatctgcccactcccaaccacccacaagtatgtatgaattactttcatgttgggaaagccatcatgccttgttttgcctcttccagtcaaaatggaaattcttgccacttgaatagagaaattatatagttgtctgtcttctttctataagaactgcttattcatcactctggttaactggattcctttattccttaacaactgcctctaagttattaatatttcttagagttcccagttcttgtagcccaaagtacaaaggatttctctgctcaaaatctgctcactgttcttatgggttaataaactcttaaatgcaaataccccttgtggtgggagaaacttataacttaaactttactgtgagttacttaagcttgacacttgacttcagtactttgaaatggattattactgaaatagaattgtgatttccaaaaagacaagtgaagaataatagacctgggatcaaataactggattattgggagaagttagcccagggaagagtaggaagacagaaaaaaagaatgcttaggataatttttttttctgccaaggaggcttggtggcaacatctttccacagattgcagaatcattttgagtaactcaggttgctgataccttcaaaatggaagaaccttaatcactagggattatatcccttatataagacatttttttttgttttttttttaagagatggggatctcactatgttgcctaggctggagtgtggtggctattcacaggtgagatcatagcacactatagcttcaaacccctgggctcaagtgaccctcctgctgtagtagctgagactataggcacacaccatcccacctggtgaagacagattttttcaacaaaaattcagaaaggttttggaacagttatataaacaaatttcatcacatgcaacattttgactgaaaaaattttgcttaacaagcatggcctttgaattgttttgggaaaaaaaaacctctagggattcagggaatcagctcagacgttaaactgtcatttttgtagcctgagatgtgccttaattcattgaggaagtctctctagcagtattggtgctatatagtgtattgatatattgctattcagttaaatggataactttcgaaataattgaataaaatccctttcctcccttagtctgagtttggagtatttgggtatttgacctaatttttccagtcattcttggaagttagctgggtcttttggcatctgttaggctttctgttatgttcaataactcaatttctaagtgttcctttttttttttttttttttagcaaatttgtaaatcaggacttgtttggtatattaatgtgattgaggctcacagtgtaaccttagtagtgattttaatcttggcatttaaaagtcactgccaagaaaatctctatgaggtacaggttgcatttccttatatttagattttaaaaatcactttaaaaaaattcagttagttatcagttactgactactgactcaatttcaagttaattatcatcttaatttcatggttttaagatgtgtaacattcacttaattgttctgtgtgtttttctttagattctactctgctactcaagtagtggtcactatgattctgtgtactcaaaacaatttcagtcaagtgcagctgtttgtcagggtatgtgaaggctttataaattgtgggtgtgatttcagatgacttgttttcactcagggacccaccatgaatagcccctttaaaaccttgttggtacctatttgcacgcaggattatgactattttcacatagttaatataaatcttattttgacaattggaattttgaccattttttcttcagctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggtaataaagggaaaggggatatcatgataattatgtttcatacttctgtgcataatcatttgaaagtggaaggggcctggcaagcttatgagttaggttacatattcacacgtacacatatgttaggatatatatttttaatggggggagagttttaccaaagagatgtgtcgtgagatgcccagacttgggggttttgttcaggtccgttttgtattgctagaagaaacttcagaactatctaattacatgattctcaaactttagttgtataagaattatagtgcttgttagaaaggcaggttcctgggcctactgtcacaaaatttgaggtcaggatgggaccaggaatctgttttttaaacaagtgtgcctaagcattctgatgtaggtaggctgtggatcatactttgagaaaatactgattctaaagtagcaccatcattttctaggtaataactgaggttagttgacacatccagccagtagaaaatttctcagtgtaagttttgggagtgttttagtgtctgcctttggtatgcactgtgagtgtgcctctgaggaaacaactgttgaacagctctagttgaacactttgggtttgaaataataaagtacatgtcttatatttcttcctaattcctagttctgcctgcaaattcagataggtttggtgctaggtaagtgtcaccttgtgttttttgtcttgcagttctatttcttggatgtttaaagcttacaattttttttctttttttttttttttttttgagacggagtctcgctctgtcagccaggctggagtgcagtagcgcgatctcagctcactgcaacctccgcctcccaggttcaagcagttctcctgcctcagcctcccgagtagctgggactacaggcgtgtgtcaccaagcccggctaattttttgtatttttagtagagatggggttcacaggtttagccaggatgatcttggtctcctgacctcgtgatccatccgcctcggcctcccaaagtgctgggattacagacgtgagccaccacacccggcagaagagggtttttaaagcttatttgggactgccaggagtggcaaccatgtattagggtaaaggttgcttcactcttcactgatcacttgtcttaaggacttcaggcttacggaaactacagtagtcggaaagcaaggtgtattagttatgttttgctgtgtagcaatgttactacaaacttgccagcttaaaacagcacatttttctcacaatttatgtggattaggaatctggacacggcttagctagatcttctgctgagtgtctcataagactgtaatgaggatgttggtcaggactgagttcttatctggagctttgactggagaaaagtctacttccccactcatggttcttggcagcattcagttccttcgagctataggactgagagcttcaagtttttgctgtcagttggcagaagtaaccctcagctctgctacattgcagtggtgaatatggctgtttgcttccttataggcagcagaggagagagagagaccagtaaaatgaatgaggcagggatcatagggatcaccctaagagtgtgttctcacaggagttgtaaaatataggaggtaatctgctaagtatattgtagcacatacttataaaaacgaagcataaatgcaaatgttggaatgaaaaagcatttgccttatttttagaactgagttaatttaccactaggtggtggtgtagtcattaggcttaacataagtaaattcttcatttataaaaagctctttgctctaaatcttttgaattaggatggaagagtggggtgcctgctacaatgctgaaaatataccagagggctacaataaaggaacagaagaaacaaaggtttgatattttctaaggcaaagaattttcatagtcttggcttgcagcatcatgacttaaactagttaaagtcagatattatattctagttatatgggttgagggaggagttggtcattttcctttgtgaaagtcttacctatctttaaacttcaaatgcatacttaatgttctttgaattcttatttttacagaattttagatttttcagaacaaactgaacacttcagaaatttcaagagcaatatgtttttaagttaaatattacaaacccaatatttagtttgtaatcagtcttctgacgctaaggtttttttcattaaggaatacaatgcctatctttattttattcaaactaggtgataatcatggtttaaagttagagaaacagaaatttcaccatccgtataggactaaaatcaaataggccttcagtttgaggctagctaaataagtcaaatactattatagcaatctctgtgtatacctgaggtgcttataattttggaatagtattgaatatggtgaaattctaggaaagcagaagaaaaatggtagttcctttggaaattttaacaggatttgaccataatgaagtaaccttcagatatttccaggtgattgtagagtacagaaatattgcacctccatgtgtatatcatgataacacttcctgaatagctctgaatttttaatcctggtttgtgttgcattggtttatatgggatgtgtcctgagtcattgccaggtttagacattatttcccttctgccatctaaaaccttttagattacttgcattttgctactttagtctcctgatttttaaaatatatggcaaaatttattgtgcgatttatttcttgttttaataaagaacgacgtggttttttttttttttaagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagactaaggattgtgagtttgtagcatgattatttttgttttagtctccagaaaatccatcaaagatgcccttcccctataaggtgctcaaagccctggatccagaaatctatcgtaatgtagaatttgatgtttggttggacagcagaaaaggtaaagaaatatcaacaggatacttttgaatcctgacaaatccaggagtataattttgcaaattatggtgaacatctcttataagaaatactgttataaaaaatagcctgatgctttttatcttactttatatatgatttaaatccaaaggagggaacatagctttagaagtgggagggatcttttaaagcctgatgtttgcctgggacttcaactttgcaaagactgtgtggagacaatttttagatagcattaagaaacttagtgactgaaaacaagctcatcttaaattccaggtgttaagaccaccttccttgataaatgagtaggttaggcctgtgggtcaaatctgacacaccaactgtttttatgtggtctatgagctaagaatggtctttaattcttaaatggcagaaaaaattaaaagaataatatatcgtgacacatgaaaattatataattcaaatttcagtgttcataacattttacagcagagtttgagtagttctgagagtcttatggcccaagaaactgaaaatactatctggctctttatggaaaaagtttaccaacccttgaaaataggtcattgtttctctccttataagataactaaagtgatcaacctaggccttaaagttttgccttcaagataagcctttagtatttcacattcaactccttgaaccctggtaaacctagctgtagttaacaatctagaatgaggttaagaccttgggaaacacagtaagttgttaaaaaaataataggttgatttgagaagctgaataatgttactttcaaattgtacctcgttagtgtttgactatctctgattacaaactcccaatttccacctatttgttttttaaagcacaaaattattctggcacgtctttttaaattgactgcagaaataactcatccagaatgatagaatcgccctttgggactttacccctattttcacttatagtggtagcgttgtcaaaggcactacggtaaaagtaaatgaggaaattaaatgatataggaaaggaaccagtttagttgagcttgaatcttcattttcttttaatagaacttcaaaaatctgattacatggagtatgctgggagacagtactatttgggagacaagtgtcaggttagttccttcttcaagaatcagtaatttttttaagaatgtgctttttgtcatgatatgagttgaacaagacttatttacaaagtactagaaactttttatttatatttttaaagagatagggtctagctctgttgcctaggctggagtgtagtggcatgatcctggctcactgcagcctcgaactcctgggctcaagtgatcctcctttcctcagcctctctagtggctgggactacaggcacataccaccatgcctggctaattttttttatttttatttatttatttatttatttttattttttttttgagacggagtcttgctctgtctcccaggctctggagtgcagtggcatgatctctgctcactgcaagctctgcctcccgggttcatgcctcagcctcccaagtagctgggactacaggcgcctgccaccatgcctaattttttgtatttttagtagagacgtggttccaccgtgttagccaggatggtcttgatctcctgacctcgtgatccacccatctcagcctcccaaagtgctgggattacaggtgtgagccagtgcacctggactatttttattttcttttatagaaacagggtcttactatgttgcccaggctggtctcattcctggcctcaagtgatcctcccaccttggcctcccaatgttgggattacaggcatgagccaccacacccagccgaaaaaaaaaatgtttctttaatgtctgtgttaaattttaattacaaatttagtgattagatgtaaggttctttcagtatgtgctgtctccattgatccagactggcagtgttgatacgaattactttaaaaagtagacactgaactccatttggggaaaagtggtattttgtttggcattagctgtatctgtcactagtcttgagactagaagtattctcttttcaggtttgcttggaatcagaaggaagatattataatgctcatatccaggaagttggaaatgagaacaattcagtaacagtcttcattgaagaattggcggaaaagtaggaatatgataatttgttgaattactgaaatctttggttcctggttccatttcgtaatattaaattgagaattaccaggatgctagtaagagaaccagaattgtatctactgttggcctaggatgacttatcttgaattataaaagcatgtgctgaagtatgaatcaatatagatattagatatgtataaaagttttcaaatcttaagacactagcctacttattagaaatattaagtacaacagaattctgatacaaaactgttcatagtaattgcaaagttgaattaataactgagcctctgccagcatgaagataagctaatctagtctttctcaaactttaccatgcaccagaattacctggagggcttgtgaaaacacaagattagtgagcccagtctctaaagtttctgattcagtaagtctgaggtggggcccatgaattttaattttggacaagtttccaggtgatgataatgctgctggtccactttgagaaccattaaatgaggctgtgctgctctaacaaccaaaacatttcagcagcttaaaacagtaaggtccttcctccttcatttagcatgtccatagtgggtcagcaaatgggatccggttcaacagagattctattttaacacgtgcatccatgatcatagggaataaaatgagaacaaaccacttgctgaatcttaaaatgtctcatactttattaaccagagtggtttacattcccaagcctcatgtcaatggggtggggaaatttaatcctccaaggaggcacagcaaatatttgtgaactaatacagtctaccacagtctttcttctgaaatgtcatcggtactagaaacagcagtgaaattgtacaaactactcttaagttttctaaactaataaaaaattaaacaaggaaactggtgtcaaccaggttttaatagaatacacttgaagtataaggggtgggatacgtgtattgaatgaaagttaagtctgtgttgcagtatcttcatggtgatacctttaacttttaaggcatgttgttccactggctaacttaaaaccagttacccaagtgatgtctgttcctgcctggaatgctatgcccagtcggaaaggaagaggttaccagaaaatgcctgggggttatgtcccggaaataggtttgtatgctaaaggttgttattttgtttttcccttcctgtacctgcttttacttacctgcattgtactattttttaaatgtatgtcatatgtcttgttgtagggtagggtttctcaactttagcattactgataatggaatggatactacttcactgtcgggggtttgtcctgtgcattgtagggtgcttcatagcatccctggcttctatccactagaaacaaaaatgtttccagacattgccaaatattccctagaggagggagaggcacagttgtccctggttgagaaccatggttcttaagggactttgtgtaaacttaagcactcatatttgagagctaaaaagaaaaaaatgatcttgtggagatgagtagaatgatggttaccagaggctcagaagggtattgggggtgggggataaagagggattagttaatgggtacaaaaataggtagtaggattaagatctagtatttggtagcataatagggtgactgtagttaacaattgcatatttcaaaaaaactagaggactggatttggaatgttcccaacataaagaatttgtaaatgtttgaggtgatagatatcccagttaccttgatttgatcattatacattgtatgcttgtatcaaaatagtgcatgtaccccataaatacgtactgttctacacctataaaaattaatttaaaaaacttaagctgacatggatcttaacctgagggggaaaaatatttcttagagacctgagggggaaaaatatttcttagagaactaggaaaatacctcatagaagcagccagggatattaacaggcataatttattagagaatagtaatgtgtgtgattggatgactcggagtttttggggtttttgtttgtttgtttgtttgagacagaatctcgctctttggcccaggccggactgcagtggcgctatctcggctcactgtaagctccacctcccgggttcacgccattctcctgcctcagcctcccaagtagctgggactacaggctcctgccaccgtgcctggctaattttttttgtatttttagtagagatggggtttcaccgtgttagccaagatggtctcgatctcctgacctcgtgatctgcccgcctcggcctcccaaagtgctgggattacaggcgtgttttgtttttttttttttttttttttgagacagtctcactctgtcgcccaggctggagtgcagttgtgcgatcttggctcattgcaacctccacctttcgggctcaagcaattctcctgcctcagccttctgagtagctgggattacaggcgcacgttaccacgcctggctaattcttgcattttcagtagagacggtttcaccatgttaactaggctgtccttgaactcctgacctcaagtgatccacccacctcggccttccaaagtgctgggattacaggcgtgagccaccgtgcctggccatggatgactcagtgttttgatgacctatactaacctgcccatgctggggatagtgccgagatatacccattgatacagaaattacctgctggttttgtccttccaaataaaagatctagtatatccttcaaaaatacaaaaattccctccctatgtttatttggtttgttcctaggggaagcattggaaagtttaaggcagtgtggtggtgacagtacactgggccttttgctttgattatgaagcttatttgctacctctttgtttgcctgaaagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggtaagacattgacagatttgtattttcatggtctagggaaatatgaagcaattgaagagatccaagaagatagaatgccatcaagatgagggtctctgtgacatacagactgtatttcattaataatagttagccctaatgccagtattgcagagagcagagctctttctagttgaatgtttttagaaagacagattagttctatttaactacagagactgactacttaggtattagtgaatagagagttctagtttcctttctctttattcttaggaattcatctcggtttataaacaggcacaacatgccgggccctaaagttgatttttacccaggcccaggtaaaaggtgctgccagagctatgataacttctcttatagatctcggtaagtattgtgttgaaagtcagagaaaattggtaagtctgatttcattgctgaacattaatgttttaaaaagtgtcaactttgagatatttgaactgttatttagaaattaggaacaagttactatatttcatcatttttacttttttattatttgaaccacttaagttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctgtgagtggatcaatgctttactcaaaaagctgtttacttttttcatttatttttttgaagtaaaggcaatgtggataaattttagattttgtacaaataaccaaacaaagccttttctggaaaatgaaaatgagaaaagagacattttctcccagctgttcctagagaagggaatagaggtagacttgataatcttgcctatagagtatgggttaatattttctattttcttgatttttacttcatattttttgtattctaaactgcatggaaaacatttaattacagagttctcttacaatagcagttcacattgttaggctagtttttaaactgccttttaaaacatccctctagcttttttttctgactatatagtgagaactgcagtgtgtgtgtgtctctctgatacagaatcatggaggtccctctacaatggttcctgctacttcaggatactgtgttggaaggcggggacatagctcaggcaaacagactttgaatttagaggagggcaatggccagagtgaaaatggtgagtcaattacagttaaatattttttaaaagattcttgtggcattagcacatcaggccagtgaagtagaccaatttggttttggcgtctctctctgttccagtagcttagttctgaaagatttatataagttcttaatgcttgctgggtttttgaatatgtcctggtatttctcagaagagtagacttctatttcattaggctgctacattgttataacttgttttcagctctctgcataggtctttagtgagttttgacttggtgtcagatatcagtatggaaaacatctattcgttgttagtagggcactattgatagttgtcctcaccatttgtatatgttaggcttttcgtgtgactggctattattttttaagactactatgaagtaactattcgatagttacttcatactatgaagtctatttgatctataaacattactctttattgaaccctacgtgatacccactctactaagtcattatattcataatatagtccttcgtgtgctcttctgaggaatgtgctgtccctattttacatatgaggaaattgagattcagagggtaaatgacatggctaaggtcatatccttggtaaatggcagagatataattttttgtaacttttattgagatataatttacatatcatacaattcagctatttaaagaatacaattcaatggttttttattcagagttgcataccatcaacacaattaatactaggacatttttatcaccacaatagagaaatcctgtgcccattaggagccattccccatttgccccaacccccagcccttggcaaccatcagtctgttttctgtctttatggatttgcctctgctggacattttttataattggaatcgtatacacacacatagccttaacagtttttatgttgactcctaccatggaatgtgtttatttttaccttgttacttttaaaagatactgtatatccctattgaaacaattgtggagcattgagtggcttaaggaggtgtcaggcattcctaatgacttgacttatgaataagttccttattttcttgtactctttttttctactagtgtagaaaaaaaatagatatttttaggaatttaatgagtaaaaaaatctagtgcaagaatgatctgtgaaaactttgtacgtgtgtgcatgcgtgtgcttaaggacatttactgtctgctctcttatttagatgacccttttgtcttttagctctatgggtagtgtggcatatttgaaataaccaaatctttgctcccaccttaaatctggaggagtttcatgcgtgtgtgtttgataagtggtgtgtttaagaatcaaatttagtttagaactgcgggtttatatttggtggaaaactgtccgattgagtattgactttctctgcatttcagtggtacagaaatcttaaaagtacttcagtctactgagccatcctttgaggacacactcattttacatgtattacttacatgaaacagattgaaaaacagatgaggcatacatgttcccttaatgtccacctaaggaaacagtggattatactcatactttatagacaccattgagtatttagtatgtgtaaagcactatgctaagttactttcacttccattaaccatcctcaaaaggcctatgagctaggtactgttactccattttacagtgaagaattgaggcacagagattaaataacttgcctaaagtcatgtagttaatcagaattcaaatctaggcagtcctcactccagagcctatgtgcttaatcaccacactgtagcctcactggaaaaattggacacaactgagttttcacttctgcctgacctctaagagctaagtggattttcagaggagaaatttgtacagcttacagctagtctgtggcttcaatatctgttgactagtgtgaaagctcatatcacttttcaggatgtatgcattttagttttgaacatataaccataaaactggtggaaaaagcaagtgctggccatttggctctgctgagctaaaaagacctatataaacacatttcttctgtcttgtcttttttccccagggcgatatcatgaagaatatctttatcgtgcaggtcagtaagatctagaagtgatctggcattcatcattgtttatagaatttcaagctataaaataatgctcattttttactttggctatattctctagagccagactatgaaacttcaggtgtttatagcacaactgcatctacagcaaacttggtaggtatttaataatagcaaagagttatagctcctactatgtactagggcactgttaagagctatacatataaatgtatttaaatcagaacaaccctgtgaggcttagtatcattctcattttgaagatgaaattgagacagaaattaactcgtgttctggaactaatatatttagagatattctaacataggcagtaatgatcttttagaaggttttattatgatttttttattagaatggatgatacatctcactcaatataacaaaagtttgcttctcctttatgctacatgtctagtagaggtctgtagaagggcttgctcaggtacttaggctgatggaaattcatccacaattgccaaggcaggaaataaaattcggtaaatggtgcactggctcttagagtttccactagaggtgatacatgtcactttcttttccatttcactggccagagcaggtcccactgaagagtcttaacttttctgtgctggaaggcaaaaagaaacatgttaacagcgctaagaactatatcattcaacttgccctccctctcataggcagaatacttgtttctgtctcaaaggaggcatcctaaaatgtcccattcagtgtaatcaaactcaaagcctaggatttctgggctatgtgtagtacttgttatattgggtccagatgtagcttcttgtgatcttgagacttaaaaccaaaaatacagaggttttattttttccccctccctccccagtttacagtgctgaagcagggactgaaatttctattcataaagggagaaaaaaacagttattggcctgtagcaattctgagaccttcatgggcagacgttgtaagggcccccaacatactcatgggactcttccctggaggaactctcgttcattttctggggctcttggttactcccaaggcccatccttccttggcagtgtttggagtaggcattggagaataatccttccttggcaaccgagcagctttctaagcttgctacttacagaagattggaggcccaagggtggttttatctcagttgaatggttttagttctggctcgtgatttctttggctgtaagattaatttattctgcttctgtttgatttcttttggtttcatgtaccaatagccatactacagttcttttctatagatatactactaagatttgctataattctttgtggttttatccttatatttctgtctatttgattgcaagtggcttgagtttatcaggcactgatggaagagccatgcattttggacatttttctacaagccattttgttgaagtgcaaggatttactaggtgttacatccttagttgaactctagctttgagacatcttaatacactcgggttttaaccaaagagttcattcttgctgcgaggtcgagttttcactgtttgtcgttgttcaaaccattcatcaatattaccttttatagtttagggttgaaacagttgttccttcaaccctgtgagtccctgtatgcaaggaatctattccctttcattcctgcctgcaaactactaattctctcctacatacacctgtcttaaaataacttgctttagacaatgccaacagttatcaaagcacaatactaacatcatgtcttctaaattgcttaccctaagagctacatgttcataatctccttctcaattaggattttgttatagccgtaccctacttctagttaccaatttctgttttagtcaagctaggttatgctgcagttaacaaccccccaaaatctcagtggcttaactcaggaaaagttgttcttgctaatgttatatagttcaatgcgagttggcagcaggctgccagactatgactgttcttcatagtcacccagggacccaggctgatggacacatgccatcatgatcatcacagcagggcaaaagatacagaaattgaacactgacatttctggtcatattttattgaccaagtaacatggtcattcttgactttggatggagctgggaagggcaatcctaccatctattcaggaaatctggaatatttatgaagaacttgaataactaccttatattctctaattatgactaaactgtggcagcttcatgtactaaatttttgtttttactgtttagacaatataccttaggaaggagaagaaaactctgatacgtaattctctttctgttctttctccttcccttactttgctccttccagagaaagttttttcccccatttcctgccaccattactattctcatatcatgtgcttttgatatcacctcttgaagtagccaagtaagaatcttaccacaagggatgacaagaatactttttttctgttccttcaatttcacttgtcacatgttcctttttgttctgaatttaaacaacctcaatagctttcaatctcttcatatgttccaagccctctgcccccatcaccaaatccatagcaaatttctattgttgctaaaataaaggataaatgtcttcagaattatcagcatacattaaaaaaaaactctttgtctttaatttttaatttcaataggttttttggagaacaggtggtggttggttacaatgaataagttctttagtgatgacttctgagatttcagtgcacccatcacttgagcagtgtaccactgtaagcaatgtatagtcttttatccctcacccccttcccaccatttcccccgagtccccaaagtccattgtatcattcttatgcctttgcttccttagcttagcttccacttatgagtgagaacatatagtgtttggttttccattcctgagttacttcacttagaataacggtctttaattccatctgagttgcttcagatgccattattttgtttctttgtatggctgagtagtattccatggtatatatgcaccacattttctttatccacttgatgattaattgatgggcatttgggctggttccatattcttgcgattgcaaactctgctgctataaacatatatgtgctagtatctgttttgtgtaatgacttcttttcctctgggtacatacccaggagtgggattgctggatcagatggtagttctacttttagttctttaaggaatctccacactgttttccatagtggaaaacagtgtacacagttgtactagtttacactgccaccaacagtataaaaccgttcccttttcaccacatccatgccaacatctattttttgatatttttgattatggccattcttgcaggagcgaggcggtatcacataatggttcttatttgcatttccctgataattaatgacgttgagcattttttcttatgtttgttgaccatttgtatatcttcttttgagaattgtctattcatgtccttagctcactttttgatgggattgtgtttttcttgctgatttgagtttcttgtagattctggatattagtcctttgtcgaatgtatagattgctagattgtgaagattttctcccactctgtgggttgtctatctgtttactctgctggttttttctttttgctgtgcagaagcttttttgcttaattaagtcccatctatttatctttgtttttgtccaacgcaggactctttgaataaagatttccaggcaaagccttctaagaaatcatgaacatttatttctacttcttatttccatgtctaacactcaaataaatgtttctctagaagcatttggtattcacttgggaacttctgagccagggcaaatgtttgctttttggcaggggctttggctatacttgaacacagactttggaattgtccatgttaagtggggctcaccttttcacagtaaggtactttttgttgtttgctgtgattacctttccctgttctttctgtgctcttactaatgtaaccaatctctgctggtagagtttttgctgccatgacagtctatcatgcatgagtccaagccattcaaaatcatttttacttttagaaagacagggtcttaagccagaggagaatgatatttgaatcttacaatatctattaaatcccgcttagataaaacgcaactgaataaccagtttacccttgtaccaagctacatattcagatagaatgccttttttttttaagcaaaactattgttggtcctatggtgcttcaagcttttaaggcaaagatcactgaaagactgtttagatttcaattatcagttacattttagtatctacatcaggacttgagttagatgtgttgaggatttctgtagatatgtaacaaaacagtcacctacatcacattttagagtgataacttttagagctttgtcttaggagtcacttccaaatttgaattttttcaggactgatcactttcatatagttttaaaatatgttgaaacaaagttattgatgtgttgtttgtttttttatttaactatatttttgtattaaagtctcttcaggacagaaagtcatgttctatgtctcctcaggacacagttacctcatacaactacccccagaaggtaatcctcatagtgttattaagcagttacaatggcctgaacacagaaaaatgaatttcctcttttcatttaccttcatcatacttcaaagcaactgcttttgttcctttaggtattattgtaccttctggtgtctgacacagtgattagtaaattaattcaacaaattattgagcatctactgtgttccagacactgttctatgtgctggctttagattactcatagtctcctgtgagcctcttttatataaagagtgagttaatctaaattacccatcaattctgtctcattaactgaaacttaattttaaagctttcctgtagaatggagagtcagcattataaaaaggtagctgaaaccataggagtaaacaagatcatcctgggcaaaggaagagattgagaagggcatctagaacagagcccatggattatcaaattttagaaaatgggcagagaaggaccatccaagagggaggaaaagcacgagagaggaatattatggaagccctaggaagagaatgtttcaaggagcagccaggtgtcagttgctgccaagaggtcaagcaacataagacttaacaaaagtctactaagatttgttgacatagagaccactggtgactttgaatacagtttcagagaaccagtgtgggtagcagccacactgcagttgggtgggaagaaaatggagactcccagtgaggacagtatgttcaagaagaatctgttaccatttactgaatatctttctgtgcacagccctgtactgggtgctgtggaaaaatagtttattctcttaaggagctgtggcctaagcagaaaaaaaaaaatacagtcttacaatgttataaaaaatgcaaggcaccttttctctttaaaaaagagaaaagtgtaggccagatgcagtggctcatgcctgtaatcccaacactttgggatgctaaggcgggcaggttacttgagcccaggggttcaacaccagccttggcaacatgacaaaactgtctctactaaaaatataaaaaattagctgtgcgtggtggtgcgtgactgtagtcctaagctactcaggaggctgaggtgggagaatcacttgagcctggaaagttgaggctacagtgaatgaaatcatgccacttcactccagcctgggcgatgggagtgagaccctgtctcaaagaaaggtgtttgcttgtgtggggcaatatatatgcatgtaaaaatgaattacaaacctttggaataatatgcaggaagcccagaggttaactgtttggggagcgggcaactaggcagacaggacagggcttggagggaaactttccattgtatacgatttaatacttgattttcaaatcatattaatgtattacctttttagaaataaatgaattaaaaaattaaagctctcaagtgacctaagatcttctgaaagaaataaccttcctatataaggtttacataaagattgactttcagtgttttagttttctaaactaattactattttctgaagtttaggatcagataatctactgtttgaaaaaccaaacttaagagttttgaactttcttccacacttacagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccaggtaggttattagcagatgcttactttggaagcctcttttcctattcatgaacatgcacatccagctgttctggtaattacataccattactttaatttccagaattaaatttatttaacctacttaattatgttctgccattgaggaatccatgagatttgagagtcagggattcaagtttattcttgaaaatttcgtgctggtaagattttatacctttcattttgctacctgctgaattaggggacttgtactagtttctcaaactttgagttaagttttatcatataagagtgaagatagcgatgcttctcaccttatagcaaacttttcaggaatttattctataaaacacgttcctttgtaatgaataattgtcctgtaaatatcataataaaagatacaggctctggaatttaaaagatctgggttagaatcctggttttacaacttattgtgtaattttgcacaaattattgaagctttttatctgtggcttgggggcactgatagtaccaattcatgaagtggttgtggacttttcagtaagttaataaaattttaaattatcagcagacttctaggaaggtggtggcaacaacagcattagcttttctgagtctcaaaataaaaatggaaatagtgaagtcaaaacccatgacacctacaaaaatctaggtgacaaggtatccccatgaaccccaggatttaagcaggtagggacaaaccactagtcacaagacctgcatgctatcagggtctatgagggagcaagaacatagaagcattgaggatgttgtcttatgtacctgagaattccaatgaataagaattcactgaaaagtagggcagacaatttggaagcagcagccaaaactgggaagggatttggtctctctaatactaggtgagtgcatgaggcacatagtagaaggacttgaagggcttagaacagtttaacctctaactcttcaaaattgacctgccagagttcccttttaggacagtattcctcactgggaagaaactgctaagagtggaatctgaattgatcaggatagagaaaagagcaggtcagggaaaagaacaaaagaaaaggattaaggtcaaatgctacacaaatatatcttaaggaataaaaagcagaatatccctacagacaatgaaaacatgttagaaatgaaacactaaacagatctaaataaactaaaaactgtgacaaactatttcaaaatgagctaaagatattaataatacaaaacattaaagaataacataaatcagaattagaaaaactcacctgaggtgatagaactcaggaaagaattataaaggggagaaggtcattttagtaatggagactaaactgtaatgagcttgagcaaatacaggttgagtattctttattcaaagtgcttgggaccagaagtgttttggacttaggatttttttagattttggaatatttgcattatgcttgttgagcattcctaatctgaaaatccaaaattctccaataagcatttcctttgagcgctatgtaggcactcagaaagttttggaatttggagcagtttgaatttcagattttcaaattagggatacccactctgtatgtacagcagataatgctttaagagaaataagagtgctttaggctttaaattttttttgtttgagacggggtattgctctgtcaccaaggctggagtgcagtgacatgatcatggctcactgcagcctggatctccaggtttcaagcagtcctgctgcctcagccccccagtacctgggactataggcacacgccaccacactcggctaattactgtgtttttgtagagacagggtcttgccatgttgcccaagctggtcttgaactcctaggcttaagtgatccacccacctcagcctcccaaagtgctgggattacaggcatgagccaccacacccggccataaactttagaaaaaaaaaaaaatgtaagaagagggaaatctaaaattgaaaaaaaaaaatgaagataaagatttaaaagcgacatatttgaagttaggcaaatgagatcaaacacagaagtctctgaaaaaaccaaagtaaaggaacaaaataatactaaaagctataatttagaaaactttgctgaagttttgtattaggttgttttcacactgctataaagaaatgcctgagactgggtaatatataaaagaaagaggtttaatttactcacagttctgcatggctgaggaggcctcaggaaacttgcaatcatggcggaaagtgaagggaaagcagacaccttctttacaaggcaccaggagagagagaaagaccaggagaaactgccatttataaaactatcagatctcatgagaatttactcactatcacaagaacagcataggggaaaccgctcccatgatccagccacctcccaccaggtctgtcccttgacacctggggattacaactcagtttacaattcaagatgagatttgggtggggacagagtcaaaccataagtttaaaaagttttaaaagtacatacttgaaacagcaccctgaatacctgagaatattgacccagagcaataaacagcagaatattctaataaagttgctagagttaaaaagtcctaagtatctaagagtctatggcatataagagaaatacaatgataatcatcaaactttgacagcattgctttatgctagaagacagtggaataacatttaagatactcaaggaaagaatatgtgaaccagcaattttgtatccagtcaaactgattttcaagcacaaagggcaacatgtgagaaaccaagaatattcttcccatgagcccttcctgatgaatctgtgagaactgtgctgtcaagcagggtaatcactagccacgtgtggaaactaaattaattacagttaaatagagtaaatctgtagttcctcagttgcattagccacatgtggctagtagctactgtattggacagcagagatatagaatatttctatcatcacaaaaagttgtattggacaacagtgtactagagaatgaactttgagttttaggctaccagaacaattagagacattgttctggtattgtgtaccagaacaattagaggcagaacaattagagacataagacgtgatggtaagtattaaatacatagttacctgtagaagtaagacaaatgagggctgagaagttgagactatactatgtaatagccttatgtttggagggtgtagatgtagttatttttttaaatgatagaattgagagaatatgggcaaagcattttttcatgctctcagtcacatcagattctttagtttagatgctcagaaagttattccgagactatgtaatgtgggctaaagcaaatgagtaatggtgggatattctaattttatcccgtgtccttgtgaaccaggattcttagtgtggaaaaaaggtaatgcagatgttatagaggttaattaaaagcttttatagtcttgaacttgaattagaagtatcagtatgaacttgagatattttatctttaaatatatatatatgtttcctcgctgtgtccactgaaaggcctgaaaacaataagtatccctagcaccgagtttgtggtcttaaaataccatttattacttttaaaaataaacggctctgtggagaaatggctgattccaggtctgagcaggaaatgttcaagatgagcctggaacatcttgtcataccagatagcaaggaacatatcaaagagtataggcattatgtcagaaggactcagaaaccatcacaaagagagattcccactggccaaagatggaacaatttgagcctcaacaaagatcattgcaatagattggaatataccaagtatgttgaatataaaagttcttagtgatattttaaaaattgcttactttaagaggatgataggaaatcaattaattttcttgaaaactggaacatgaaataatcaaacatttattctgccttccttatatgaactatactactgaatagccaaatagatgaggggaagtatctttttgtaatagtattctaactaatcaattaaaaagtgaaaataatttttcagttcttattaaatggatggacattaaacatcagtagctactaagattgcaaagtcagtcaaacattagctatggatgttatagatgtcccaaaggaatcagtcctgaatttgattcagtctcctggatctagctgcctattgacaggaaataaagaataacatgttggattgcagcatgagtatgtaatctgcaaaatccagactatgggaagcttgtcaggtcaaagggcccaggttctttaaagcagaacttgtcaggaaatgggtggaggaaggaccaatagattaagacattcaagaaatatccaattttttaatggatgagactaaaaaactgctgttcaaggatgcacatttgagtgacaaaactctgaaaagaccccaaggaagtgattactattaaagtcaaaacaacagttggttatggtaggagggaaaagtatttataggcatgggtagtatccacattaaaataactcattaagcagtatatttgatttgtttgctgtatctgttttatttataaaaagataaagtgagcagggcatggtggctcatgcctgtaatcccagcactctgggaggccgaggtgggcagatcacctgaggtcaggagttcgagaccagcctggccaacatagggaaaccccatctctactaaaaatacaaaaattagccaggcatggtggcacatgcctgtaatcccagctactctggaggctgaggcaagagaatcacttgaactcaggagtcggagtttgcattgagctgagatcacatcattgcactccagcctgggcaagagcgagactttgtctcaaaaaaaaaaaaaaaagtgcttagcacagtgcctggaacaaaaacatacaataaatgttaatgatgatatatttttttcactggaaatgttaatgtagacactacttttactactttgtgctagttgtaagggaaaatgtttgctgtctgcttctagcagctgtctgagcttaaattcaagtgacagatgaagcaagcattgtaatgttttatttatgtggaatcattgaaagattacgatttaaatgccagatttttctaaaaatgcatactgccttcatttatttgctttttgttctctcagtcacttaatgaacctcaactatagatcttctttactagatctggctgatttttagttgctctttgtcattcttgtcaatcctatagatgaaacgactgatttttcccactttgttcttcatatgtctctctggcaggccccttccatccttaagtgactgctaatctgccaggtaacaagatgtgatgattgccttcaaatatgagtctccttttaggcattaaatcctgtcaacttcaaactctgggtttcagtaaatgttcccaagtcttttgccagggctgggatcagtgactgtccctgagtgcaaaatttaatggaatgccaaaaaaaaaaaaaacagtaatcaagataaataacactttaattcatcatttttaaaaataaagattaatataaaaaatttgagaacaaagtatcaattgtaaataaagacaggatctgtgggtcaggtttaaggtgcattgagtaaggcatatacccttggggtcatacaagtacagggttggatcctgtctttactgaaaattttgatgttgtattcataatagctttctttgtattagttttggtagccccttaaattttgcactggagcatctcaccacaccttggccttggccctggtctgtgatttctagagaagcagcagtatcttattgtatatatttatgttctcttctgaagtgtcctgaagcagactacagctacatggatgggggaaatcagcattctgaatgcattacgttgatttctactagtattttagaagacgtttctataattcttgagacatcccttgaagtgtatctgttaagcctgtggagctcttcttaagtctgaggatgagaagctcatgcatctctatagaaacttgaaattgtaaaagcttttacttagagggtttattgtaatactgtgcatttataaggaaggtgaattcagacaaagtaacctccaaattgtgtctactcttgattctttcaggcccgtgagaatgtatttagccacttctatgtcttggtttttacctagtgatcataatcacattctactatcttcagctaattgcctttctccatttgcttttttttaaaaaaatggcatgatacgttttcagtgctagtttaaaaggaataagagcagagctttgttggaggagccattttatttaaaaaaaatctgtatctagaacatttggggatattctgaaaattaagttcccctcccaaaactgtaaaagtagagatttcgaaatatatgacaaaactccaaaacagctagttgagcaagctttaaaaacttactgtttaatttagatacagtataattcatttttttggtgcccagttctgtgagctttgacaaatgcgtagagttgtgtaaccaccaccacaatcaagagataattgcatcactcctaaacagttgtttatcaagttttacatcacctgaagacacagacctattactgttagcctgtaaatgtacaaaagataagatgagtatattgttagtactggtcactaaatggaaacaatgtggattatgtcttgctaaaatatcagaataacaaattcagcttgtgtgaattgttcctatgctcctatgctaaactcagtgtgctaaaactctgactttaaacatttatagaatgataagactaaactttctatgtttctcagggttaaaatgataatgcagataacaaaatgatgaaattttgtacttggatttaagctggctaaaattattcagttaaacttgaaggtttgtatcattcatcttttgtaaaaaaaaaaaattaacaaatttgcgtgttatgtcatacatatatgcaggtatgtgtttttactaggttgtaaccacattgtttcctttattgtcatagaggattaatatttaaatataattacatctgaatttcttatgtcaaaaacttttaaatattgattatttctaagctatagtaacaggtatagaaagctaaagggataagatattgtatctaacctgtttttagattctgtacctccttagaaatggaacgttcatgatttaaagttccctatattcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagtcaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaaggtaagtagattttgagacttaggtgagggatctgagacttaaaaaatattgttagagcatatctctctttggttgacctattggggaatggggaaccaaatgaaaattgacttgagaacacaatactggaagtgactaaggaaaggagcaattaaaagctgaaaactgagaatatcttctacataatcaacaagtggatggttgagttgacgtgtgctgctgttttgttttgttttgttttgttttggtagctacatgtctaccctgaagaagattctcaaatgaatatctttgcttttcttaactgtttttccttgcaaaacaggacttggtatcaaatttttctttatttcttaaattctttccataagtgcatgaattattgcagtcttttatatttagaatttcaactgaattttaaagatttgggggagtggggattaggagtcttatctgccttgaatttcagctgtgttttcttaaacatctaaggagagtagtttttcattggaagttctttattactcagtttggcatatttctcaagagaattatagttgagaattgtttgtagcttatactttcttgctataatattttcttggtttttctagctgcttctctatttttgcttttttttttccaacccctaatcaccaagattttctttaactcccttctgttttttccctacctttaaacttccctgttacttctgtgtagtttattcctaaatgtagctagccttggcatcagaagttttagtttcttgtctccagatacttgctagacattttcacttagctttttagttttcatttcaataatgaaattcctcatatttatcttttccccagaccacacaaaacattgacttttctccttggttttttattttgttaatagtggtatcatttccacctaattttcccaatatctaaaccctgatttctttactactctcccttcccttacctacctgtacccgagatgtacttagtcaccacataatgctgattttgtatttttccaatattttactatgacaatattcaaacattcatccaagttgaattttaaaatgaagtcatatctatcacttagattctatcattaacatttatactttatcacatatctatccatcttcccctccatccatctctattaatccatcttctttttgatacattaagtaaattgtagacatttgtacacttccccataaaaacttcaggatacatatcattaagtagttttttccttttgatgtgcagtttacatataatgaaatgtacaaaacttaaatgcacattagcttacttttaacatatgcatgcatgcacttgtgtaacccaaatccctatcaaagtataaagtattaacattgtcccacaaatttccctcatgctccttcccagtttttcccgtgctctccctagaggcaaccactgtttggacttttttctaccatagattagttttacctgttttagaattttatagaaatgtaatcatatagtatataatctttatggaaagcttcttaaacttggcataattttgagatttgtctgttgttgcatgtgtcagtagtccatttgttttcatggccgagtagcatttcattgtatgactgttccacagtttgtccattctcctgttggtgatagatagctggactgtttccagtttggggctgttacaaaaaaagctgctaacaaaaaaagctgctatgaacattcttgtagaagtctttgtaaacagatgtttttatttcccttgggcaaatacctagcagtggaattgctgggtcatagagagatatgtgtttacttttataagtaactgccaaacatttttccaaagttgtaccattttacacttccaccagcagcgtatgagaattccagtagtttctcttgctcaccaacgtttattgtcgccacactccttaactttatccattctggtgactgatcatgttgtaaaaaaatctattttatagagcagttttctgtttcttgccaaattgagaggaaggcatagggatttcccattttccaccggcccccacatgtccgtagccttccatattatcagtgtcccccaccataccagagtgtggaatatttgatacaatgatgaacctaccttggcacatcattatcatccagaggccatagtttatattagtgttcattcttgctcttgcactttcatgagtttggaaaaatgaatgatgacatgtatccttaattatagcatcacatggatgctataatggagcatttctaccccagaaatctgtgctctgcctattattattcatcccccaactcctgtcaatcactgattttttactgtctccatagttttgacttttccagaatggcatataggtgcagtcatgcaatatatagccttttcagaatggctcttagcaatatatatttaagtttcctcaccaaatcattatctgaatgtaccacagtttatagatccattcacctactgaataacatcttggttgctcccacttttggttacagttgccctaaacatccatatgcaagtttttttgtggaaatatatatagagagatggagtcttgctctgtcacccaggctggaatgcagtggcgtgatctcagctcattgcaacctctgcctcccgggctcaagcaattctcctgcctaagcctcctgagcagctgggaatataggcacccaccaccacacctggctaatttttgtatttttagtagagatggggtttcaccatgttggccaggctggtcttgaactcctgacctcgtgatccacccacctcggcctcctgaagtgctgggactacaggtgtcagccaccacgccctgtggaaatatatttttaactcctttgggtaaacaccaaggattacaattgctctattgagtaagaatatgttttatttggtaagaaactgtcaaactgtcttccagagtggctataccattttgcattcccaccagcaatgaatgagtgttcctgtagttccacatccatgccagtatttggtattgtcagtgttctggattttggccattctaataggtgtgtaatgatatctcattgttttaatttgcatttcccttatgaaatccgacgtagagcatcttttcatgtgcttatttgccatctatatatctttggtgaaacatctgttaagatgtttggcccatttttaattcaggtagtttacttattgagttctaagagttctttgtatattttgggtaacagtccattatatcaggtatgtcttttgcaagtattttttccaagtctgtggcttgtcttttcattaagtgtctttcacagagcagatgtttttaattttaaagaactctaacatataaattatttcttttatggatcatgcctatggtattgtatctaaaaagtaatcgccagtcttggggtcatctagattttctcctatgttatcgtctaggagttttatgttttgcattttacttttaggtctgtgatccattttgagtgacctttttgtgaagtatgtaaagtgtgtgtagattcatatttttgcatgtggatgtccagttgtttgagtacttttttcatgtgcttattggccatttgcatattttttgtaaagtgttcacatattttgactactttcttttttattgggtgcttgttattgagttgcagacgttctctgcatattctctatgctagtcttttgtcaggtatgtttcgtgaatatctgctcctattctgtggcttatctattttcttcatggtgccttttgatgggtagaggattttaattctgatggaatctaattgatcattttttggtgtgtattgctttctgtaatctaagcaactggccgggcatggtggctggcacctgtaatcctaacactttcggaagccaaggcaggcagatcaattgaggtcaggagttcgagtccagcctggccaacatggtgaaaccctgtctctactaaaaatacaaaaattagctgggagaggtggtgagcacctgtaatgctagttactcgggaggctgaggccggagaatcacttgaacccaggaggtggaggttgtactgagccgagatcatgccacactgcactccagcctgggtgacagagcgaaactctgacttaatttaaaaaaacaaaaaaaacaacaaaaaaccttggccttatttgtcttactccaaagtcgttatgattgtttcctatgttttcctttaaaagcttaattcatttagttttatgtttaagtccactattcatctcaaattcatttttgtggatggtggaggtgatttttttttctttatggatctccagtattccagcagtaccatttgtgaaaaagattttcctttcctcgttggatcactttggtgttttagtcaaaaatcaaatgactgttttaagtgcaggtctatttctgtgccctcttttgttgcattgatcaattttttaatccttacatcagtactatactgtctttttagtaaggtttgaagtaaggtagggtcatttgcatgtctcttacactatcaaattttaccaaaaaaaaaaaaacgtctggaaattagggattgtgtttataatctatggctcaatttggggagaatgccaattcttaacagtatggtctctttgaattcatgaacatagtatcatagtatacccgtcaatttatttaggttgcgtttggtttctcaacttttttttttttggtgtagaagtcttctacatcttctgttaaatgtgtccctatgtatttgggtttttggaactgtagtaaacagaattttaaaacttttattttccaattttgtcctgtacataaaaataaaattgatttttgcatgttacccttggctgatttattaaaaatctgtgtttcacagagtgtttttaaaaaatatccactgcctctttcctaggtcatgcctttatcaccttgtccctgaacagttagagtagcttctccattggtctcactgctctggtactattccactttgtgtctgttcctagctcagaactcttcagtgattctttggtttctgtagattaaagttcaacagactaagtatggcatttatgactttccacaatctagtctctattccaaccttatctctttctactcctatgtgaactctatgtagcaggtttttttctcctaagcctttgctggcgtggtgcttcaactcaaattctttccccattcacttccatctaagttctactaaccccgagaatatatcatgtattcgttagtaggtgctccccattctccctggccttagcaatcgctcctctagtttggccatggatttgcctattctggacatttcatgtaaatagaatcatacaatatgtgggcttttgcaactaactttttttctctaagcatactattttcaaggttcatgttgttgcatgtatcagtactttattcttttttatggccaaaaaaattgcattgtatggatgtattggcatactccattttgttgcactttgctttattgtgttctacagatattgtgatttttattttttttacaaattgaagatttgtgagaaccctgtgtcaagcaaatctattggcaccatttttccaacaacatgttctcccttttctcccttcatttctgtcagcatttttttagcagtattgtattgtattgtttgtttgtttgtttatttacttatttatttatttatttatttatttattttgagatggagagtctctgtcgcccaggctggagtgcagtggtgcaatcttggctcactacaacctctgcctcccgagctcaagcaattctcctgcctcagcctcccaagtagctggcattacaggcacccgccaccatgcccagctaattttttgtatttttagtagagatggagtttctccatgttggccaggctggtctcgaactcctgacctcaagtggttcgcctgccttggcctcccagagtgctgagattacaggcgtgagccactgtgcccggccagcaataacatattttaaaattaaggtatgtacattgttttcttagacctaacactattatactcttaaaagactacagtatagtgtataagcataactttttttttttttttttttttgcaacggagtcttgctctgttgccaggctgaagtgcagtggcgcgagctcagctcacagaaacctccacctcccaggttcaagtgattctcctgcctcagcctcccgggtagctgggattacaggcacgtgccaccacacctggctaatttttgtatttttagtagagacggggtttcaccatgttggccagaatggtctcgatctcctgacctcatgatccatccaccttggcctcccaaagtgctggcattacaggcctgggccaccacgcccggccataagcataacgcccagtacataagcatatttactgggaaaccaaaaaattggtgtgactcacttccttgcaatattggctttatttttttctggaaccaaagccatgatatctccaaagtatgtctgtatcatattttatctattagttgaggaacatttgggttgcttttactttctggctattaatactgctacgtgcgtttgtgtatacaagttatttgatacatacatgtatcaagtagaatcccatgccactcatgaatttatttcctactatttttttaaaatattatgtagcttgagcattaggctttatgctgtgctcctatataatagtcaaaatacaagctgattttaaaaaaaaatggcaataaatgtatttgtatgtgtagggagtctccaacttaaagagggattttctaaaagttcatctgttagtggaactcaggttatattactttataaataaaaatatgtgtggatctcaggtcaaacaataaaaatacatttagaggtccaattggaatgctaagaacagtttttgttcatttatgaaatagtttagtttcataacgtcaagagaaattaccttgctcattgcccttctctttggagttctggtggtggtatgtcagtcatggtaaataaaaacaggatgaattgtttcatattgttctaattgtctcagcaggcatcactaatctctgtcagtgagtattagtctgtactgtatataagtgctagtaactgaggaccaaaatgattgtttatgttctagaagtgtattaaagtaaaaattccatcttgaaacaaacaagaaaatgcctttattggattcttcctaaatattaccaaagtgacattcctgtaacatctgcctacaattaagattagaaataaaaattttatttggtaactaaaccgtagatgagaaaataattttacctatattggtaggtaagtagtcatttactataaggtaaaattgagagtggtattaatgtggcaagattacattgatatcttaataatgctcaaacagaaaagcttttttttttcttttttgagatggagtctcgctctgtcacccaggctggagtgcagtggcatgatctcggctcagtgcaacctccatctcccagattcaagtgattctcctgcctcagcctcctgagtagctgggattacaggcacccgccaccacgtccggctaatttttgtagttttagtagagacagggtttcaccatgttggccaggatggtcttgaactcctgacctcaagttatctgcccatctaggcctcccaaagtgctgggattacaggcatgagccaccgtgcccagccagaaaagcttttaaaagataattctaattgcttatgtcagtcaagtcactaatttttttgatttttaattttagatacaaaagttttgcagtactatttcaatctaggattgcaggtaagtgccatgttaaaatttctttgataagccctattttcaaagtatagaccgttttgataatcagactcttgaacttcgaaagccaaaatcactaaggggactaaacattttaattctgtctaagagatctctgaagatgacatagttcagttgtctgctttagcctcccagtgctttagtttctcttataaaatagtcgttaaactgaagagaggggtactgggctgtaagcagcacaatcagcatatattagatgagccatcatatttaacattacatgctaacttttcactgtggtgttctgtctcaaaataaatgaattatcctaaaatatttttatgactatctttccattttatgtgaaaattagacaaatttgaagaaatttaaggcactgtattttgttctttgaaaccaatgagaacaaagacacaatgtaccagaatctttgagacacagctaaagcagcgtttagagggaaatttatagcactaaatacccacatgagaaactgggaaatatctaaaatcaacaccctaacatcacaattaaaagaactagagaagcaaaagcaaacaaattcaaaacctagcaaaagacaagaaataactaagatcagagcagagctgatagagacacaaaaaacccttcaaaaaatctgaatccaggagctggtttgttttgaaaagattaacaaaatagatagaccattagccaggtgaataaagaagaaaagagagaagaatcaaatagacacaataaaaaatgataccacagaaatacaaactgccatcagagaatactataaacacctctatgcaaataaactagaaaatctagaagaaatggataaattcctggacacacacaccctcccaagactaaaccaggaagaagtcgaattcctgagtagaccaataacaagttctgaaattgaggcagtaattaatagcctaccaaccaaaaaaagtccaggaccagatggattcacagccgaattctaccagaggtacaaagaggagctggtactattccttctgaacgattccaatcaatagaaagagaggaactcctttctaactcattttatgaagccaacatcatcctgataccaaaacctggcagagacacaacaaaaaaagaaaatttcaggccaatatccctgatgaacatcgatgtgaaaatcctcaataaaatactggcaaaccgaatccagcagcacattaaaaagcttatccaccacaatcaagttggcttcatccctgggatgcaagggtggttcaacatatgcaaatcaataaatgtaatccatcacataaacagaaccaatgacaaaaaccacatgattatctcaatagatgcagaaaaggccttctataaaattcagcaccccttcatgctaaaaactctctataaactaggtattgatggaatgtatctcaaattaataagagctatttatgacaaacccacagccaatatcatactgaatgggcaaaagctggaagcattccctttgaaaaccggtacaagacaaggatgtcctctctcaccactcctattcagcatagtataggaagttctggccagggcagtcaggtaagagaaagaaagaaagaaagggtatacgaataggaagacaggaagtcactttgtctttgtttgcagatgacataactgtatattttaaaaaccccattgtctcagcccaaaagctccttaagctgataagcaacttcagcaaagttgaagttgtgtgcaacacaaaatcagtgtgcaaaaatcacaagcatgtctatacaccaataatagccaaaccatgagtgaattcccattcacaattgctacaaagagaataaaatacctaggaatccaacttacaagggatgtgaaggacctcttcaaggagaactacaaatcactgctcaatgatataagagaggacacaaagggaaaaacgttccatgcttatggataggaaaaatcaatatcatgaaaatggccatactgcccaaagtaatttatagattcaatgttattcccatcaagctaccattgacttccttcacagaattagaaaaaactactttaaatttcatatggaaccaaaaaagagtccatatagccaagacaatcccaagcaaaaagaacaaagctggaggcatcgtgctatctgacttcaaactattttacaaggccacagtaaccaaaacagcatggtactggtaccaaaacaggtatatagaccaataggaccaatagaacagaacagaggactcagaaataacaccacacatctacaaccatctgatctttggcaaacctgacaaaaacaaggaatggggaaaggattccctatttaataaatggtgctgggaaaactggctagccatatgcagaaaactgaaactggacccattccttacatcttatacaaaaattaactcaagatggattaaagacttaaatgtaagacctaaaaccataaaaaccctagaagaaaacctaggcattaccattcaggacatagacatgggcaaaaacttcatgactaaaacaccaaaagcaatggcaacaaaagcaaaactaaaattgacaagtgggatctaattaaactaaagagcttctgcacagaaaaagaacctatcagtgtgaacaggcaacctacagaatgggagaaaagttttgcaatctatccatctgacaaagggctaatatccagaatctacaaggaacttaaatttacaagaaataaacaaccccatcaaaaagtgggcaaagaatatgaacagacacttttcaaaagaagacatttatgtggccaacaaacaggaagaactcatcactggtcattagagaaatgcaaatcaaaagcacaatgagataccatctcatgccagttagaatggcaatcattaaaaagtcaggaaacaacagatgctggagaggatgtggagaaataggaacacttttacactgttggttggagtgtaaattagttcaaccattgtggaagacagtgtggtaattcctcaaggatctagaatgaggaatacaatttgatttagcaatcccattactgggtatatacccaaaggattataaatcattttataaagacacatgcacatgtatgtttactgcagcactattcacaatgccaaagacttggaaccaactcacatacccatcaatgatagactgcataaagaaaatgtggcacatacacaccatggaatactatgcagccataaaaaagaatgagttcatgtcctttgtagggacatggatgaagctggcaaccattctcagcaaactatcacaaggacagaaaaccaaacaccgcatgttctcactcataagtgggagttgaacagtgagaacatacgggcacagggaggtgaacatcacacattggggcctgtcgcggggttgggggcaaagggagggagagcattaggacaaatacctaatgtaggtgacagattgatgggtgtagaaaaccaccatggcacatgtatacccatgtaacaaacctgcatgttctgcatgtgtatcccaaaacttgtgtaataaatataaaaataaaaatagctgcatttttaaagcactcatgtgttcatagatgcttgctcaacactgttttttcaccactcccctgagttgtagaggcaggtgggtactgacaaatgtctttatcagtgaaaggtgtctccgagttgaggtgagagctcttttattttagtctttcagggatcactttccctctgaaatacacttgacttaaaatgtaacaagatggcatatttactgaaaggaataatgcatcttaagatctgtcagatgatgataaactctgtgctctcctggataatgctcagattagttcatattccctgacactgatttccctgaagctttagacatgtcagtgccaagaaaactgtcttcccaaatagtacacatctataaattaagagtaatggggtgggtttttgttctttgagactatttttcctaaatttagtttcaagaattgataaaccgcttgccccttctgttatgttagtttattatagtcacatgtggaaactttgtaatctatttcactgaggcatttaaaaatattctgccttttacatcatagaataccaggagatgctgaatagatatttcagtatttttcttattagaaatcatagtgtccattgtagtacattttgaaaatactgtggtataaagaaaactaaaatcacctctatgatcactgtatactttatatattttcttacaattttgtattttacaaactatggattatgctgtataatttttaaatcttttaacaatacaagcattttttctttaaatatttgacagcatgattttcgttgcctgtatagtatttcattacgggtatataatttatccagttccctgttgttaaatactatgtgcaatgttttttgcttttaaaaatactataaaagacacctttgtatacaggtcttttagattatttcctaaaagaattcttaggtttaaatatgagatacaaatgctgcaaaagatcctaaagttctaatagagaacagactgtcaagtttttaggtcaaaaaagtcattgctacctcacctgaaaatcgtggcccaattcttattttttttttttttttgtctgtggggaactgtattacattaagaatagagaagagtgaagtttcttatttttttgttgccctttcttgctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatggtgagtgtgtaatgagattgccagcaagaaagacagttggattttattgtgtgtaattcaataatagctttcatatatttcatcaggtccatgtactacaccagtgattctcaaagcatgatatgtggacctcttgtggtccctaagactctttcaagggattcatgaggtcagaagtgttcacaataatactaagagtttatttgcccctttcactggcttgcattttcattgaggacatagaaaccagtggtgggtaaaactgctgacacctaagcactagttggtactgaccccagactctgctagtaatcagtgtttttctcactgccacacacccatggtacaaaaatgccaatcttatgtttttttgtttaatcaaagacatttttactaaatttttatccttgaatagttgtatttttctttgtgacaaaaatggaactacttataaaacacttctgcatactaaatgaagtataatgattaacttaaggaaaaagacttgtgctattaagttatgagttgtacttgctgacttgaaagagggataagctatcattattcacacttagttgatctggccggcattttcttaaatgaacaaagtgagcctgtcactttaggataaataactagtaatatttgttgccaaagatacaattttagctttcaaataaaaattagaattttggaaaacatgtatcttccaccatgagcttgacaccttcccaccaattaaaactcctgtaataagataagtagagctgaatgtagtttcttaaattgtatgaggaaatgtgtcaacatttggaagatctgcataactcagtgaaggaagagtttcccaattaccaatgcatgatatgaccaaggtgtgatttttgtaacagatctttccaagtgcaagataaaacagtggattttaatgtaacagagcatgaaaaatccacattgctagtgacctttgaggaactaccacttatgtagtttgggtgtagcatcaaagaatatctacaattatctgaaaggctaggtattaaaatacttcactgagccaggtgcggtggttcacgcctataatcccagcactttgggaggctgtggcaggtggatcacctgaggtcaggagttcgtacctgacttgccagggttgttataagaactaattgggaccttatgtataagtatactattacctggtgcatattaggaatactaatttctctcttcctttccatttttaaagcatattacagtgtcaatcttttttttttgaattttgtgcagtataccttttatagagctatttttaattgtagttaactatgaggcagtggcagtcttaatttcacagagttaatctaagcccaagtaatgaattttttttttttttttttgtctaatgtgtatactcattatagcaaggttaaaacagcatttatttctactggaactgactcatggcaaaagtgctatgaaattaaaatgtgatcttaatgacattcaggagatgacacttttagggtgttcttcagagctatactttcaggtatagaccagaatgtctagacacctgagtttttcattgctaaatggttattcggatgatgtatactgtaaaactattggataactcaattgtgaccacctcttacaagaatttaattaactagaaggactctaaagaatatttatgtatttagcttgctgatacctaaatcatcccagaaagatagctgtctgtacattgaatagatttgacacatatatttcacagttttttaatttggaaattttcatattatctttactcattatttgtatttaaagtgctcctgctgcaattgctgtgatctttcttatagttagttttattttcacacataagaacatccatttatgttgcatggggttctgttttggtgaatttttgtatataaagtagactgtatacatcctttctttcagatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgcc

SEQ ID NO: 5844 - DNA, 79437 bp, human
gaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtgccgctgccccttagctggcttctgcccacgcccggcggggcccttctccggctacccggccactcggggttgcctgtttcctcttcccattattccggccgctcctctccctcatttcttcagctccttttccggtctgcccccgcgctctattctccgcctccgcgtcctccgcccctccttccaacggctccgcccctccgagctcgggttttccaccgggctcggcagtttttcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaagtgaggcagaacgggtagtgcctgggttccccccgagtttgcgactccttttccaaagtcttttcctgctgtggctttcgcgggactctgcgagctgggtcgcttagattcatgagtgcttgggaggttcctcgtcgggccccggaccagaaaatagttttgaaaactaagtgaaatcggccacagataggctttttggcggccgtgctccgatgttaacgtcaaactttagtagtggtggtggttcctgctctgttttacatagccagtttaaaaggccctcacattctgatttcctctttcagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcctaagaatctcagggttgggtcttttaattttaattttttttaagttctggggtattctgggggtacatgtgcaggatgtgcgggcttgttacaaaggtaaacgtgtgccatgcatcacctaggtattaagcccagcatccattagctttttatcctgatgctctccctccaataaggaactgacacttgaaccttttcgaggtaaaataaaatcgctagctgaactcactgtagccctttttgaatacacaacttatttgaatatgacaattgagaactttactggagagaacttagtattttggggtgagagaagaatgggaaattaaccactgtagtccacctttacaataaaaaaccctaaacacagaggagcaaaataatttacccggggaagtgtaataaattgtcaacttgacattagtacttgggcttagatctaaaggagtgttctgcctgctgattggttggattggtcatggagaaattggaattgtaagattgtttacatttctgttgaatgtgagtgaaatgaatccagtcaaaaataataacagctacatactgtgtaaattgtttcctcttcagaggaccgccctgatggtctagttaattagacttctagtgcattcagaagaactgcttttggggagcaatgcagttttgactgttgtgaagaaaggtgtttcgttttttcctttcttttttttttttaaagtctagtttgaggagagaaaagtctttagaaatagacattaccaacagattcgtgattaaaaatgtatctcctaggaggtaacagagcctttggcactgctctgaatgctttgtgtatattaactttacttttttaaacaatcctgtgaactaagtactgttagtatctccattttacacatgaggaaactgagacacaagagtggttaagtaatttgtccagccgggaagtggtggacagataacaatctggtgctggagtttatgttctttttttcttttcttttcctttcctttctttctatttttttttttttttttttctgggacggagtttcactctgtcacccaggctggaatgcagtgatgctatctcggctcactgcaacctccacctcccgggttcaagcgattctcctgtctcagcctccccagtagctgagattacaggtgcacactaccacgccccggctaattttttttttctttgtattttagtagagacggggtttcaccgtgttgcccaggctggtctcaaactcctgagctcaggcaatccacctgcctcggcctctcaaagtgctaggattacaggcatgatccactgcacccctccggagttaatgttgttaactaaccaccctagcataagatacccaaaaaggacttatctactcacttatcaatctccttgctctcatttaaaatagttagatgattttacatttcaaaattgaattgatcctaatattctatatttgcatattcatggagatctatccttgactatttctgggatagcacctcacatgtaaacccataagaagtggtcagggtttttcattattgatgcctgtctgtctctattgtaggcttgcttttctacttggggttgaatagaaatgaagtatagtttcacatacagtatgtcaaacctggatcttatttggattcaaggccatgcccaaagcatactccagatggcccatcgtacaatggtttcacttagagtttttcaactttatggtggtgtgaaagcaatacgcatacacattcagtagaaaccgctcttcgagtacccatataaccattctgttttacacttggagtatttaataaatggcatgagatagtcaacactttatcataaaataggttttgtgttagatgattttgcccaaccacaggctaatgtaagtgtgttctgagcatgtttaaggtaggctaggctaagctgtgatgtgtggtgggttaggtgtattaaatgcattttctatttagaatattttcaactgcttttttttttcctttttttttgaggtgagttctcactctgtcacccaagacagggtgcagtggtgcaatcatagctcacttcaagctccaactcttgggctcaagcagtccttccgcctcaggctccccagtagctgggaccacaaccaccatgccttattgtttttgtttttattttgattttttagtagagacaaggtctctctatgttgcagagagtggtcttgaactcctgggctcaagcgatcctcccacctcagcctcccaaagcgttgggattgtaggcataagccactgcacctagcctgttttcaacttatgatggggttataccccgtcacaaggctataccccatcgtaagttgagggtcattggtactagagagcaagtagcatagcactgaatcataggccataatgtcatcatcagtgataaagtaatgtatttttcaaataaagtttctagcactttttattagagagcaactgataactatactcttgtcattttgaatgtataattgaaagacctagtttgtagttctgtcaacttaagttttttaacttttgatttctagctataaagcttcgtggggaccttaacttatttcaaattgtgttgaacaaatttgatttatatttgtaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatctctgtgttgtatttctatgtgtatctgtggctgtttctttgcatatgtgaatatctgagagagtgtgtgtatgtgtgtttatttaggcgtgcatgtctccaagacactaattttggagttctaaattttgagttcattatttagattttcattattcaaggaagacaatttgctcattttagttaaaagttttgcctatagtaaatccactaaaatccctaaattatatttactctttcatttattcagttacacccaatatataaaaggcactgttttaggtgctgtggatacagtagtaaacatgagataaagtccctgttcttatggtgcttacattctagtggtggaaaattgataataagttcacaaataaatgatcaaggtatttcatgtggtgaaatgtactatgaagaaagtaagacagggtgatgtggtagctggggtgaagactgattagaattgtcagagaaggcttggcagagtacctaacattttgatctgagacccgaaatacaaggaagagccagtcatgtgaagatttggaggcagaaggaacagcaagtgcaaaagcctaagtaaggaatgaacttggagcttggtgtgtttgaggaacagagggaagattagtgttgcaggagcatagtgagcaagggaatataatagaagatgaagttgggtgggggtagcttatgtaagagttctgattttattcatgtttattgagaagccattgaagtattttaagcagagaaattatggtaaggagtattattttctacaagtatattagaattcaacaggaactgatcatcgtaatagaaggatgaagaaaattacttgtttgttttctattagttcttccttgagacactagaagcttgccaaagggccaggtcagtaattcccacttgtttgactttaaaacctatcctagtttgatgttgcaagaagtaaatgcctcatagaattactatatatgtgtatatatatatttatttacattatagtaaaatgaaattaattttaaaataaaaaacctgagaagaaactggctggagcataatttttcttttagttttactgcttctgtctcttaggcactcagtaaatacttattcattcattaaatatttattgagtaccttctatgtgccaggcattgttctaggcacttggtatacatcagtgaacaaaacaaagactcctgttcttaactgagaggaggcagattcattgattatttcaggagtgaaattgttggtgtccttatcactataatgttggagaagagggaatgtcagggtggctgtgtaacatagaagccagtcttgaactatttagtgagtcaggagagaagctagattaaagaggaataaacttatcttcctaactgctttatgcaagtcaattttttccagatacttttaattagtattttcattctaaatgttaaatcagctttgattttgtgttagtacattaaaaggaaaacactgatttcataaacatatcctgactttttactcatgctgaaaaggaaggaaactgtacaagtctccaatttattttatttttatttttttacagttttaaatgtctttttttctatattaatttcaagaaagtcacataaaagcagtaagcagtgagaaagaatcagtaattgattggttatattttcttttctttttttgagacggagtttcgctcttgttgcccaggctggagtgcaatggtgcgatctcggctcacctcaacctccacctcccaggttcaagcaattctcccgaatagctgggattacaggcatgcaccaccatgcctggcctaattttgtatatttagtagagacggggtttctccatgttggtcaggctgatctcaaactcctgaccttaggtgatccgcctgccttggcctcccaaagtgctgggattacaggcatgagccaccacacccagccaataattggttatattttcattttaggtaaatcatttattttccccagacctaggctggggggtagtatgtttgttctaatttaagcgattggtttaaataaatttccgatgtaatggttctatgtttaaaaccttatttccagcatacatggtggtgtggtatattgtttaattgtatatgaagttatgatagtaaattactggcaaagattatttcacagtcttcatgcatggtctagtagtttccccagcttattatcttgtctggcagctattacttttggtttcaatttttaaattctgttttcatgaatgaattgtgcttcagtttaaatatgcccagtcctgagaagtattacaaagccatgtgaagacatttttcatgaaatatcatttctgaaatatatcagttgacataggagataaggtatctgctgaatttatattgacattttatagtactctttgtattgctttaataatcctagtatgtatacttattaaaatatataaaaattcacatgtgcagtttttagaagtaccactatattcttggaagttagattcagtcatcagtgggcagcagatgaagtatggaattttctcccatgttacctaatatttttcttcttttgttttagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaatatatggttttaaaattgacttaacttgagcaagatacattatgaagttctttctgattagagtgtgtggtctcaagacctttacagtagattatccttaagtgtccatagctctctggtacaatgtttagatatagtttatctatcaaaatagaacattcactataaagacctctcttccattccaatcatattatcccaacatgctaaatgttccaaacattttatttggaatgcattttatcatgtttttataggtttatttttctgattgtgttttatttaggctaatattaaaaaaatgcttactagtggtagaaggtggtgacaaagaaatactctgggtagcaggaggaagccaacttggattaaaattttgctgagaataatctaaaaagtgagtaatctggttgagaattcacagcaccataatcataattgtatatcaatgttatgttttaggaaaggtcctattcaaatccagggagagaatctttagtgttttctgggccctcataaatacgtttttctcatttgagaaaattgtgactttatgttggtcacttagtttttatagtttatgatgaagaattaaagagaaacaaatgaaaggcaaggtctactcaaatatcagacaactaaaaggctatacagcccctaaatcctttgctatctacttccccagaataatgcataacctaaattccattatttcatttagcagaggtttaagccgttgttgtcaattgtgtgcagtaacgcctctgacttcccttttgtggaattttgtatcgattttggatttttaagtcaaaggagactttaaaatcattttgatttggcacggattcttgagattatctagtccaattccatcatattcagattttaccatttgcttaaagtatagcttttggcagaactgcccctaggagcagctccttgattcccagtcccctgctctttctaccctgcataatatatgttgtaagctttttgtttctttatagttgtttgcctagtgttcattttagttactcgaattccttgcaaggtaggttttgtttgtttatttatggaagttatttagtaggaatttcacacttaactgggttttcctttggcgtatgacaaccttacctaggacttagaaatctgtgatttctgagtttttggaatttaggaaaatgctctgggtaggattgatagtagattgaataaattaagactttaagacagaattgtagacttttggagttgggagataatttaaagaatattttaaaccaccagttttacagatgaggaaacatgctaaattaatcaccacatttacatcttattagtccttattaaagaatggtaaccaaaagtctgtttgaaatgtttgctctatttgtttggtttcattacatgacagagctgcaggttcttgatattaatgagtaagtggaatgcagtttatttagcagtgttctattagaggtactgaaattttcagggataaggaaatgaaagagagtttagcattgggaaatttgcaccatggatagattaagaggtagacagttaatagaacatttacgggttggagtagatgaaaagagatgtgatgttttgggatgaccttgggaattaaggattttagatacttataatttgggaggaaagaaagctcaaaggatttgttggtaagatagtataaccaatgaatttgacatagggttctggaacatttaaaagtagtcattatctgcaagtaccatcaagtatctgattttggacaccttagacctctactttttaattttaatttttttttttttgtattttagtagggacggggtttcaccgtgttgcccaggctggtcgtgaactcctgagctcaggcaatccgcccgcctcggcctcccaaagtgctggttttacaggcgtgagccactgcacccggctctactttgtattcttttaaaggcaagtcatatataggcacaaaagagtacaaaaaggttgtttgccactttaatatttagtttgaggaagtttttcaagactaagtaatgactagcagtaatataaatattcttcctggccctttattgtggtataagcacgtaattcctctgatttgttcataaatgtaaaatttgtggagatgaccaaaacacttcatatagtctgagaaatgacacatggacagatcatttgaaattaattttggggaaacatttggaaagggtcatcatgatagccatgtggtgatcaattttctgctgtacatgtaataccatttatttatttatttatttatttattttgagaccaagtctcgctctgtcacccagactggagtgcaatggcgtgatctcggctcagtgcaacctccacctcccagtttcaagtgattctcctgtctctgcctcccgagtagttgggattacaggcatgtgtcaccccgtggggctaatttttgtatttttagtagagactgggtttcaccatgttggccaggctagtctcaaactcctgacctcaggtgatcctcccaccttggcctccaaaagtgctgggattacaggcgtgagccaccacacccggccgtaatacgatatttttattggggagtggggagtgaaaaataattttggttaacactagtgcttagtatgtatcaggtactattcagagcactttacacatatatactcatttaatctttaaatattcctgtgcaataattggtattgtccattctacaaataacataatgtgaaaaaagttgtatttcattttagggtccaagagatgttgtggaaattgtaatttgaacactgaattccagtatacttccatcctttatggggacagtaggagagaatatttgaaatcagaggattttcctaagaaatttagattgtatgttagccacaggcgtaacggtatgctagccataggtgtataacctttttgaatttttacattgctacttaaaaaaccacagtgatggctactcatagaatccatgtgtagaatccatgtggagaaactctttcaattggtttacctgattgcaagttatttacaaatctttttcttttttcttagttgtattttaaagtttcattttggtccttgctttatttcttttcttggaattttcagcattcccacagcttctactgttgactcctttatctgtatctcccaactctgatttgggctcctaaatgatatttccaattgcctttggccctgtctgtctgttaattctgtaagcacctcaaactcaaggtgtgccccaaactgaaatcatatttcttttcattcttctgaggtgcttatctttattaatggtatcatcatttagtcattcttctagcctttaactctgtctccaaccccttatatctaattggtttccaagcactcacagctttatttcctaagtacctcaagcttatgtattcatcattcaggcttttaatataaatgcataatgagaatctaccttttgtatcagcaggatccaagacatgattcctgctctgaaggacctatgtcttactcatttttgagtcctttgcctgaaacacagtaggctttccataaatgatgaatgcacttctgtaacctagtactcttttttgattgtcttgattaggattaggtattgttctaggaaacactgtcatcttgtacacatttatttcatactgactttgatttgacagcgaagtatctagtaagtctcttgttcagaagatgtgaccatcatattgtatggtaagtttgtaggatcaagcacatataagaatagcatcccaaatataacagtgctgattctatgcagtatcttaatggtatttaagggtctgtcaaataatggtacctgtcagggatttgtggcaaaacatgatgttaaaaatcaggtatatgaaaagcactatagtgttttctagtaaaagcttacatagagaaaggtttaggatattaccaaacaattttttttttcctttgagacagggtctctctgtcaccgaggctggagtgcagtggcaagatattggctcctctgcctcccctggtcaagtgaccctcccacctcagcctctggagtagctggaaccacaggcatgggccactacacctggctaattttttgtagagacggggttttgccatgttgcgcaggctggtcttgaactcctgggctcaagtgatctgcctgcctcagcctcccaaagtgctgggattacaggcgtgagccactgtgcccagtcatcaaatgatatttaattacttattaagtggctaatggctaattccctacgtgaatgctctatttattatacagtttttaattcttttttttttttttttttttttggtaggcggctaaacaaaaggtagacaaatctggctaggttcaaacaggaatgtagaatacatgatgctatttattttttttttttttaacggagtctcgctctgttgcccaggctggagtgcagtggcattatctccgctcactgcaacctccgcttcccaggttcaagtgattcaccctcctgagtagctgggattacaggtatccaccactacatctggctaatttttgtatttttagtagagacggggttttgccatgttggccaggctggtcttaaactcctggcctcaagcgatccacccacctcggcctcctaaagtgctgggattacaggcatgaggcactgtgcccggccagaatacatgcttcttaatgttgatactgattcttgaaaaatattttgacaggcttttaataccattatataccatctatgttggtatttctatatcttcattgtcttataaattttttaccatattctggccaaaattacttattttgattgacacttgtatcatagctttgaacatgattttattttggtggctgcagtcctgttctctgaggcagtggttcttaagcttctttcagccatggaactctttaatttaaaactgtggcttttcttctctatatacatgattttgcagtgactttcagaaagtttgcaggacctcatggccccgggttaagaatccctaggctgaggcgaacttcagtaacttcatttcttggtcattgtttattactattttggtcttaattcctagactcatttgtaattaaacccttttgattaattacatttaaatttagtaattcccagtttttatttttatttctatttttatttatttattttttttttgagacaaagtctcgctctgtcgcccaggctggagtgcagtggcgcggtctctgctcactgcaagctccgcctctcgggttcacgccattcttctgcctcagcctccggagtagctgggactacaggcgcccaccaccatgcccagctaattttttttgtatttttggtagagacagggtttcaccatgttagccaggatggtctcgatctcctgacctcgtgatccacccgcctcagcctcccaaagtgctgggattacaggcatgagccaccactcccggccagtaattcccagtttttataatgtaacacaaattcaatactttttttgtttaaagcatactagccaatacatttttgaaactaaccttaatattcttatgctattaactcagtatctgtaacccataatgtcatatagtgtcttttctaatagataataaggactaaatggaattttttatttgtagtaattattttagaatatcctataatagactggtgaagaaatccagtaaggcaatacaatatggtgtttactcatggttaagtgtgctactaaagtacttggttgcaggaccctgatagtcactgttggaatgatgtctatgagacgcatatagtacatctttttgaatgatcatttctccttttgtgcagcattacatactggtcaattctccactgccagtgtgaagtgaggggataatacactccccatatttagtaatgaaaaacattcctaagtccttagcctaaattagtagttttctggatctcagttttcctgtttgtgaattaataaaactaacttctcgggtgatttctaagacataaacctagttgtgtggcatgttttaaaaattaaaaatgctgttgaaataacacattttctcttggttagtttttgttttgagaagtaggactaagatctatttttagaattcacagaatatagtcctaaatgatacggaaagcagatttttcattgaatttcatgtttaaactcatactcagtttctaattggggttatagttagataatttaagtttatttagaagtttaattgaatgagtctttccagtgcttcaaatgttctgggttttttccctccttctgctaatcctgtctctagactgatcagacactgcaggtatcttaagtcaaaaaacaaccttctgctgggcgcgggggctcatgcctgtaatcccagcactttgggaggccaaggcaggtggttcagctgaggtcgggagcttgagaccagcctgaccagcatggagaaaccccgtctctactaaaaatacaaaactagcccggcttggtggcacatgcctgtaatcccagtcgctcaggaggctgaggcaggataattgcttgaacctgggaggcagaggttgcagtgagccaagattgcgccattgcactccagtctgggcaacaagagcgaaactctgtttaaaaaaaaaaaaaaaacaaaccctcagtgtttgtgtgccagtgtggtatattttaaagcaaagtaatattttcctttaaaaaaaaatctgtattgtcatgctatcaggtggaaatggggaagagaagaaaatgaaagcaagtggttcttgataatattttattttgcaattccgaagaaggattacttctttgggaaatccattctttgtcttgcctttatttctccttcctaaaacttgaggaggaggttgaacagggctgccaggccatgctttgttttagaaccattgtgttcccttccttcataaatcttgctttgctaattctgcttgaatgttcaccctgaaaagttgataggctctagttccagggtgctgttaaaatacatttttaaaacacattaccattatattttcagtaatgaaagaccctaaaaagaggttctgtagagttatttcccttaatttgcttcatgttatttggtactaaaaataattgaagtaagttatttagggctaatttttaaaatactggcttttcagtaggttctgttacaagttgttatatgttaatacatgggtttgttatctttaaaaatctaggtctgtttatgtggtaatgtcagatttattcatttttatgtgggccagtcatccccactttttgccaagataataggctaacacccaaaagctatttttaatattgatcacaaatttgaccacttaaaggaaggtgttatcaatattttaatattgattacaaattttaccacctaaagtctgttatccactgttgaatcacagagtaattccctacatttggaagagtgcttagagattatgcagcccatctacttattttacagatgaggaaactgagacttaaagtggtacagccaagttcataacattcttttcatgataccatattgcctctcagaaactaataactcatagcattttgtcatacacatttacaactataccttgtatgtcacaggtaatgtatgctttaaaaaaataattccggacatacctcatttaattggttgaaacgtgaagtgttattttagaattaaaatcattagtatttatatgtcacactacagtttccttgtttatcagtgaagaaataaatatagcaattaaaagggcaaattacgtattctagctaaatttcagtataaaaagtagtcattgcaaaattaaagcccatcagtttcatgacaagtaaactatgttatttaaagttactttaatgttttttcaacttattttaatctgtacccagagatacagtgcttaaaacttaaaatgtcttttttaagacattttctttccattatacttagatgtcaaagggaataattccattagggatggggaaacaggatatggacccatattagaactttgatttccagtagaatttcagtgaaattgctctggttcttacctttttttttttttttttttttggaccaaagaatgattgcttgctgaatgttttgtcaggtagcagctaacagccatccatatttaagcacgaacgtgctaaacactgaatatacagtgtcttttgtattattctaacaaccttaggtttaagtcacaaaaatttctagagcagtgtttctcaaactttgaaacattaataggtgatctatggagggaagaaggtgtttgataaaggctaggtcaaaaatgtgaagcatttactataagcattccttaggacctttaatgttgctaatgggcactgtgaatctcaaggataggattataatatgcaaagtttgctgaaattttggccttgaaattctctttttaggaatatgttgttctagagcagtggttttcaaagtgtattccctggaccagcatcatcatcacctgggaacttgttagaaatgcaaattcttgggattcatcccagacctgcctcagaatcccttgggcaagaggcaatcttttaacaagccctccacttgagaaccactgttctggaagtttttcaggactaaagtagtttgctgtggagaaagccaattgggatttcaagtgcgatatttcaaaggacagtattaaataccttgaagtggctttttattatatgcaagacaaagtctagaatcgacccacagttctctttaaaatatcctattgtactaatctgcagaatggaacctctgctttaccacttctgggcttttgttcatgttttttctgccttggtatgtaattcctctttatggtaattgtgcaaacatcaggagattttatatagttttagtttcagtactgttactgattggatgtgaaaacttaggtaggtcttaaaactatttcagacctgtttcttcatctgtaaagtaagagatcccttggagctgtaaaattccaattacttgttttcccagtttatgatgctattgtttcttgctcactaatgataaaatgtttaaatttgctttctaaaattaaggtaatacatgtgaatagttaaaaatgttaattgattatacaaggcttacaacaagaaacagcagttgtatgtcctattcctccgcatctctgttcctgcttcttatagatgaccgtattactttatgttttataaataatatgcttaaactggttttgttttgttttttaaatttgaatatcattgtaaccttcctacatggaagaggagacttttcaaaaattaatgtttttaatttacacgtcacaattgtatatgcatttatagggtacaatgtaatgttttgctatttgtgtacaatgtggaatgattatgtcaagctaattaacatattcacctcacttacctatcattttttatggtgagaaatttgaaattcttattttgaagtacacaatatattattattgactgtagcgactctgctgtacaaaagatcccagaacttatgtcctctgtctgtctgaagctttgtaccctttgatcaacaactcccattttctcttttcccactcaccccccagcttctggtaaccatcattctaactctctacttctatgagttcaacttatttagattccgcatgtaaatcatgccctctttgtctttctgtgcctggcttatttcacttagcatataacgtcctctaggttcatctatgttgtcacaaatgacagaatttcgtttttctaaacactgaatagcattccattttgtatatgtaccacattttctttatccattcatccactgatggacacttaggttgtttccttatcttgggtactgtgaataattctgtaatgaacacgggagtgcaggtatcccctgacatactgattttatttcctttggatatatacccagaagtagaattactagatcatatggtagttctatttaattttttgaggaacttccatactgttttctataatggctgtactaatttacattcccaccaacaacgtacaacagttttcttttctctgcatccttgccaacacttgttatctttcatcattttaaataaaaaccattctaacagttgtgaggtgataatctcatgttttgatttgcatttctctaatgattagtgatgctgagcattttttcatgtacttgtttgccatttttatgtcgtcttttgagaaatgttcgtttagttcctttgctcatttttaaattgggttgttttcttgcttgttgagttgtttgatttccttacaggttttttttttcgagttatttgatttccttacatatttggatattaaccccttatcagatgtatagtttacagatattttctcaatttctgtgagttgtctcttcactttgttaatagtttcctttgctgtgcagcagctttttagtttggtgccataccatttgtctatttttgcttttgttacctgtgcttacagggtcatattcaaagaatcattgcccaaagaagtgtggagcttttcccctatgttttcttctagtagttttgcagtttcaggttttatatttaagttttcaatccattttgagttgattttttaatatgatgtaaggtaaggatccaacttcattcttctgcccgtggatagtcagttttcccaaccccatttattgacaagactgtcttttccccattgtgcattcttaatacctttgttgaaaattgaccataaatgtttaggtttctttctgggctttctatcctgttcctttttttgatgtgtctgtttttataccagcatgatgctgttttgattatgctcactttatatatgatttgaagttagggagtgagatgctgccagctttgttctttttactgaagattattttgtctatttgggatcttccgtggttctatataaatttaaggatttttttttttctatttcggcaaaaatgtcattggaattttgatagagattgcattgaatctgtggatcactttggtagtgtggacattttcacaatattcttccaatccataaacatgggatattgttccgtttatttgtgggttttttttttttttttcagtttttttcatgagtgttttatagttttcagtgttatatcagtcttttacctcattggttacatttatacctaagtatttgttgctattgctattgtaaatgggattgttgtcttaattttctctttggataatgtagaaacactactgattttttatatgttgattttgtatccttcaactttactcatttttttaatcagttctaaccattttttggtgtagtttttaggtttttctatatgtaagagcatgttatcagcaaataaagataatttcatttcttccttttctagtaggatgtgttttctttctcttgcctaattgctctggctacgatttgtatgttgaatagaagtggtgagagggggcatccttgtcttgtccctgatctcagaggaaaagctttcgatttttcactcttgaaaatggtcatagctatgggtttatcatatgtggtgtttattgtactgatatacatttcctgtatacctaatctgttgagaggtgtttttttttgtttttttttgtttttttttgagatggagtctcaccctgtcatccaggctggagtgcaatggcgtgatctcggctcactgcaatctccgcctcccaggttcaaacgattcacctgcctcagcctgctgagtagctgggattacaggcgcccgccaccatgcccagctaatttttgtatttttttttttttttttttttagtagagatgcggtttcactatgttggccaggctggtattgaactcctgacctcgtgatctgcccgccttggcctcccaaagtgctgggattacaggtgtgagccaccgtgcccggccaagagtgtttttgtttgtttgttttttcattatgaaggggtgttgaatcttgtcagatgctttctctgcatctatttaaatgatcatgatttttattcattctgttaatgtggtgtatcacatttgttgatttgtgtatattgaaccttccttgcagccccaggataaatcccacttgagcatggggaatgagtcttgtaatgtgttgtggaatatagcttgctagggttttgttgacgacttgcatttatgttcatcagggatattggtctgtaaatttctatttttgtagtgtccttgtctggctttggtatcagggtaatgctggtcttgtaaaatgagtttagaaatattccttctttttcagttttttgaaagagcttaagaaggattggtactggttctttaaatgtttggtagaattcagcagtgaagccatggggtcttggactttggtgggagacttttattattgattcaatctccttcctcattattggtctgttcagattttctatttcttcatgatttagtcttggtaggttgtatgtgtctaggaactcatccatttcttctagactatccaatttgttggcgtataattgtttatagtagtttcttgtgatcctttgtatttctgtgataacagttgtaatgtctcctattccatttctgatttgagtctttttctcctagtctagctaagggtaggtcaattttgtttatcttttcaaggaactaactcttagtttcgtttattatttttctatcatttttctagtctctttcatttatttatgctctgatctttgtttccttccttctgctaactttaggttgttctttttctagttccttgaagtatgttagattatttgagatctttcttcctttttagtgtaggcatttaccactataaatttccctcttagaactgtttttgttacatcctgtaagtttttgtatgttgtgtttccattttcatttgtctcaagggttttttttaatttcctttttgatttattctgtgacacattgacttgttcagaagcattttgtctaattcccacatatttgtgtgtttttcaagattctttctgttactgatttatagtttcatgccattgtgatctgaaaagatgcttgatatgatttcaatttccttaaatttgttaagacttgttttttagcctaacaatgtgatctatcctggagaatggtccatgtgtgcatagcaagaatgtgtattctgttgctgttggattgaatattctgtatatgtctgttaggtccatttggtgtaaagtataattcaagtctaatgtttcctaattgattttctgtctaggttatctgtccattgttgaaagaggggtaatgagatcccaaagaggagactttttcttttttctcttccccattttccttcctatcctcctaatttagttttatcagttctgtgagattcattttcaatgttgacattattatgactgcttaactacggtattattcacatctgagccatgtagtgttcaatgattttatttcctttcctgtaaaactttgttttatctcattttgttatttcatcattttcccactttttgatagtaacatctccaaactttccaacagaagtgtacatctctcattatattcaaacacatcgggttatctaaacctttattatcttttttgagatatccacactggagttctctgtcctatttttggaaatgcttattttctagtccttctgagtgtctatcttcctgcgatttccccttcatccttatcctgtaatttctctttgcttttctcttgtgttgaatctcctatttccaagattgctcccttccacccccagactttaaaaaaaaaattctttattttggtttcacatatcttcagtagcttttctgagaaagggtggcaacatttttgaatctttttttttttctaaaaacaccttgttttactctttcatttgatagcttgcaatagaaataaaggttggaaataacttcccctctaatctagagcttcattgttttccgaatcctagtttttcttttgagaagtatattgtgttcttatttgtgttcttttgtgtataaactgttcttcttctgtgaaagctttaggatcttctctttatcccctgacttcagaaactttattgttatgtccagggatgatcttttttgctttcattgttgtggctgcttcatgggccctttcagtctcaatatggatactcatgttctacagtgctagaatttttttatattgtcatcatcatcatcatcatcatcatcatcattatcatttctttccctctgctttcctcatttcacttcgggcttcctgttggttagatgttggctttcctagattaataatctaattttcttattttttcttcccaatattgttgactattctgtgagctcctcaactctgttatttcttctgcttttttgttttacttaactgttaaatttaaatacagtaaaattggcctgttttcttatatagttctataattttgacaaacgcgtaatcatgtaaccactaccacagtcgagatgcagaacagttccagtgcccccatttatcctttctctttgtagtcagcccttcaaccctaactactggcaaaaactaatctgttttcctttcctatagtttggcctttttcaatgtcatataaatgcaggcatacagtgtgtagccttttgactcatgtctttttttgcttcgcatgttacatttgagatacgtgttcttttatgtatcaatatttcattattttctattcctaggaagtattctattgtttgaatgtaccacagtttttgtccattcaccagctgaaaaatgtttagattgtttccagttttgagagctcatgattatggataaagctactataaacattcacatagaggttttggtgttaccatttctcttatgtagttacctagaagtgggattgcttgatcatatggtaattctgttcaattttataagaaactgttaaactattttccacagtggttgtactattttacattcccactagcaacgtatgagagttccagttctatatccttttcaacacttggtattgtcagttaaaaaaattattttagttagtatgcagtagtatctcattaaagacacacaaatggccaataagcagatgaaaagatgctcaatatcattagccactggggaaatgcaaatcaaaaccacagtgagataccacttcacacccaccaggtttactataatcaaaagatggaaaataacaagtgttgataagaatctagagaaaatggaaccctcatacactattggtaagaatgtaaaatggtgcagttgctctgaaaaacagttcctaacattaggttaaatagagttaccatatgatccagtaactccactcctaggtatatacctaagataattgaaaacataagtctaaacaaaaacttgcatgtgaatatttatggaaatattattcataatagcccaaaagtggaaacaacccaaatttctatcaactaatgaatggataaacaaattttggtttatgcaggggattgaactatgtagtgatgcaccatgctccaacatgggtggactttgaaaaccttatgctaagtaaaagaagcgagtgacacaagaccacatactttatgatcccatttgtttgaaatgttcagaatatggaaatctatagattcaggaagtagattagtggttgtctggggttggtggggatagagggattagaggttgacagctacaggatgcagagttttattttgggataaagagaatgttctaaagttgattatggtgatggatgcacaactctatacaacaaaccattgaattgtatactttaagtgggtgaattatatggtatgtgacatatctgaaagctgttaaatttaccagttttaagagtacaatttaatttttagtgaatatacagaattgtgcacatatcaccacaaaatagttttagaagatttttattattccagaaagattctttgtgcttatttgtagtcaatgcctatttccactccagccccgggcaaccacttcatctgctttctgtctctagatttacccttttggcatatttcatataaatggaatcatattccttttgaaatcatacagtttttgcttccatcttcttaggaccagtttctccaatccttgttaatgcttgttactgtctgtattgtttattacagctatcctggtaggtatgtaatgatgtcttattgtggttctaattttcattttcctaaagatcaatgattttgaatatctttttatgtgctcattagtcattcttatatctttggtgaaatgtgtattcaaatcttttgtctatttaagaaattggattttttttattgttgacttttcagagttctttatatattttggtacaaagtttttctggttagatatgtgatgtaaaaatattttattccagtctatggcttgtattttcattctcctaacaatgtcatttgcagagcaaaagtttttaattttgataaaatcgagttaatttttttttctattatgtatctgagaactcactgcctaacccaggatcttaaagattttctcctatgttttattttttaaaattttgaagttttattttacatttataccactttgagttaattatagtacaaggtgtgaggtataggttgaggatccttttttttgcatgtggatggtcaattgttctggcaccacttgatgaaaatgctatcttttttctattcaactgattttgcacctttgtcaaaaatcaatggaccatatttgtgtggatctacttctgtgtgcttccctgtgtgttaacttttctcttgctctgtctccttttgtcttcctgtccctacttgtgtttttttttcagttttctattacttttctgattctctccctccttctcctgattttcccttcccccattcccttcctcaaaatgaagcatttagattgcattgttttatatatcatacttatttttagtttaaaaagcagatgtgaagcatttgtgtttttctttacaagtacaatatgctggaaacaaattaacttttaaattataatccctttttttttttttgagacggagtctcgctctgttgcccaggctggagtgcagtggtgtgatctcggctcatgccattctcctgcctcagcctcccaagtagctgggactacaggcgcccaccaccacgcccagctaattttttgtatttttagtagagatggggtttcaccgtgttaggcaggatagtctcgatctcctgacctcgtgatctgcctgccttggcctcccaaagggctgggatcacaggcgtgagccattgtgcctgaccaaattataacccttaattaatttttctcagtgaattagtgaccttaacgaaagatggcaatctctcttcccaaactgtgtgtttcagaacttctgcaaaaggcatcacttctccagtgttacagtttctttaaaaaagaaattagtggctggacatggtggctcatgcctctaattccagcacattgtgaagctgaggtgggaggatagctttaacccaggagttcgagaccagctgggcaatgtggcaagaccccatctctacagaaaatagaaaaattagctgggtgtggtggtggcatgcacctgtggtcttagctacttgggaggctgaggcaggaggattgtttgagcccaggaggttgaggctgcagtcagctgtgttcacaccactgcacttgcacttcagcctgggtgacagagtgagacactttaaaaaaataaaaagaaattaaggtaatttcaaattggcatgcaaaggaagtcaagatttattccttttttaccatgtcaaacattatttcattcccaaattataaaatattgctgcttttcctagagggagcagtcatgattactactggatccacagatacaaaaaaaaaaaaaaaaggaaaaaacaattttgaaagcagcttaatgttgtgccttctctaaagccagcttttgacctatttatttttaatacttaaaaaatgtaagaaaggaattggatttttgcatttaaataaaaataaaagacactagatagtatagataataggaacaaataaaacaagcaattgggcctgcctttggcacttagtattttctttggttttctcagaatccagagtaatgtgtctggaaaagtacactagtaaaacattgaaacacatctctcattgtccaactcatctcatactctaccataccatttcaaatgtagtctatccatttgtggatattttcatgctgcttccatttaaatttttatttccatttttaaagaaacacacttttttgcatttttcttttttattggtgccatatagtagtttggaggcattagtcaagaattgtataaagtttccctagcatggctaataagatttagtttctgtgatcctggcagagattattatctagaattaaatgagaagattacttcaaccctatatctgaaatatccaggtaatagccttggcacttagcttgaactgtgccctctgccgctatagattaagggaagttccttctccttttttgtgtttattaaaaaggtattaatgcaaatgcttactggttaactaggttcatgaagattctgtccctccatgtttccctgaaactatgaaaggagcagggaatttggggagagactgtagttgaaaattcagctagagatcttaaagcaattcttcaagcaatgtaatgtggaccaggctgcatcctacacacctgagccttattgtagtcccttttcagcctcgtgcagcagttgccccgagttaagctgcaaagtcagtttccttctagacccaaagctcagctgcttatgcatacttttctcaaccttggtctgattgggttagattgggttaattccactctttcccaaggaggtaactctaagtactttctccctccctcccatgtctcctgcttagtctgagttccctattcctaggaggattggctcttcctcttcttttcacagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcaggtaaaaggaaaacatatcttccctgtactgagttttcagagtttgagacatgggatggtcctgtagtttgccagaagaaacaaaaaaattcccctgctttctagtgaaaacatcgggcctgtcaaggtcctagagagaagctgcctgctcttattagcttggtgcatgcctttgctgaatagtctatattgctgaacctttgctatcttttctgtttttttaaatgccagtttgtaatgtaggaggggtaagataaggaggctaaagacaactttgaaatatatcttgatcctttgtaagcatcccctgcttcctctaattttaatgcctaagaaaaaaattataggctgtgcacataaggagtagaaaaggggatggggcatgacagtcatccttcccccatttcgttgaagatgatattaaaaaaacttttagtaagatgatttaatttcccaatttcctacatatgttctgaataaggaagccttaagtgtccagttcatagtcttgatttagaagtgcctattttaaatgactactgacagtgggctggtctttctcttctttttagttgttttgcagccaggtccatcatttggaaatcaggaaggcttgtgtctcatatatgagggaaaatcaacaaacttttgagtctgtaagtagaatacatacccaggggagaactggtagagtgtgtagcaggtggaaaaataattgtgagcacctaccaaaattaaactatatcatgctgtctcctcaatagcaaatatataattcccaactggctcccttcccagtagctaacatgcttcttgagcctctgctagaattaggttgtttaggactctaattaaaaatcaagaataatctacattttcccactacttacctcgtcctacgccaagaactccagaccctaaaaagttatgttttgattgctgttttatattatccatacagttttattgaacaattaataatagttcatgaaaggtttggctctgttaatattttgcaatgcatattttaaaatacgtaaaaatgggaaccccctctattttcttgcttaatcctgtgtacaataatcttcagccagtcaatttgaggaatcttgtaaaacttaattgtaagggaacaaatgagtctaagtatctagtctttccatgtcacaaattgtataattagagctctgccactaatgattaactttaggtaaaacaacttacagaagacatatttgtacaccttcatgtatttgaattcttgttaatgaaattggaggcttccttttcttttttttttttttaaacacttctggcccttgcagtgctatttgtttcttctgtttattgtgggtattcgcctgctgttcgagttttactcctaattttctcaactggtttcagtgaattttaaaactatgtgaagacttcttgacttaaaagcttgttaccttgaagttcattgtagtcttctctacacctggggaaaggattattagtaacattacttcaaatgcaaggccatagtgtaaagcagtgcgtctcaagtatttctgtgcatacaaatcacctggagatcttgttaaaatacaggttttcattcagtaggtctgagttggggcccgagatttctttttttttttttcttaccttgagacagggtcttctctgttgcccaggctggagtgcagtggcaggatcacggctcgctgcagcctctgcctacgaggctgaagcaatcctcccacctcagcctccaaagtaacttgggactacaggcacacgccacctcactgggctaagttttttgtgtttttagtagagatggggtttcgccatgttgcccagactggtctcagactcctgggctcaagtgatctgcccgccttggcctcccaaagtgctgggactacaagtgtgagccactgcgtgcagtggagatttctgcatttttaacgaactgaagtaatgcttgctattggtttgtggacaacattttgagtaacaaagatgtgtgtaaaattttaaaactacgtaaatgaatctcaattcagtactgagtgatagaaaccagaccccatgcaaagtttatactgtttgatttcccttatataaaactctagaaaaaatacaagccaatctgtagtgacagaaagcagatcagtggttatatgtcagttatagaggggcacaagggtacttacggaagtgatacattcaccatctcaattgtgatgatgatttcatgggtgtatacataagtcaaaatttgtactatttaaattgtgcagtttattgtatgtcatttatttattttttgagatggagtcttgctctttcacccaggctggagtgcagtggcacgatctcggctcactgtaagctccgcctcctgggttcatgccattctcctgcctcagcctcccaagtagctgggactacaggtgcccgccaccatgtctggctaatttttttgtatttttagtagagatggggtttcaccatgttcgccaggatggtctcgatctcctgacctcatgatctgcctgcctcggcctcccaaagtgctgggattacaggcgtgagccacaacacccagcctgtatgtcatttatatctcaaaactttttaaaaggaaaatttaaatgattttttaaaagtctagtgatatgtatccatggaactagaaataaatctattacagtccctgagtttaatttcatttttattgaggcatattttacattcaataaaactcgtcattttaagtttaccatttttagttttggagatgatatgcaatcatggaactaccactgcagtcaagatatagaatgtttccgtcacccctaaaaggttcgcttgtcccatggtctttttagaaactaatgaaattctctttaaagttcctcagtttaattttgtaaatgcatgttttgtcaaatttgaaatccttagaaatactggtcttgcttgatttatgaaaattgtcattacttaaattggcatttcaaatgaaactcgaaagcataccatttgatgaaatgcactggtatgtggatatgccaggaccaattcctaagatacttttatactccagcttttctccactcatgacttttgtgtatgtgcaaatcttcttgaggtgctgtgcaaagtagatacttacaccataattgttgagctgagcaaaaaacgcattgcaggataatgtagaatataatcagatttcagtaatgctgtgtatttggttaagttgagtttgttttatttttgaagtatgtggagggatcttttgagaaatacctggaacggttgggagatcccaaggtaagatcaaatatgggggtttaatcttttcagagttatttggaatagtaatgtaaatttattcattcaactgtattattttagccagaccccaaatattttatttagtagccagctgtgttgaatccaatagttctcacataagtttagaggctggcaattgaccaattgttttgtgttgaatattgataattgtgtgttaatcccatcaaccatagactagcaaaagagtatacactacttggaaacaggacaagcttaagccttttcactttaacgggggaggagggtggtaatgaattttaccaagaggtcattattttgttattaaacaattcccctgatttgtagttgtcttcctcttatgtgggagtaaaattcataaattcatgctttatttagaaataatttttatgtgataaagttaattccatagttctggacttaaaaaagcacatttactaaatccctactgcctttttattatactagttccatttttattgtgtttttaaaatctctcctattaactgtccttattacttaatggctaagtagggctttagatccttctttcaggataagtttatgttaataagtagctatcacagtattccaagccttaaaacaggttatagtgtgttctacaaattcttcatctaaaacagtgctaagcagctaaaaatttgttgtgcttgaaaaaactacctcctagctacagaatgttttttaaaactcaatacactatttatgtttaggaaagtgctggccagctggaaataagagctctttctctaatttataagtaagttatatcctcttttctttgagagtgggtatgtgcatgcatgtgtgtataagatctcaacggtctcttcaggattggggaaatttgagatttgatgtattgatacctagaatgaagaaagctaagaaaaagtgttaaaatattttaaatggttgaaaagtcaaaagaagaatgtttcatgggatggaaaaattatataaaattcagatttcagtgtctgtaaagctttgttggaacacagttatgctcattcacttacgcattgtctgtggctgctttcatgctaccaaagcaaagttgaataaaccatatagtctgcaaaagctgaaatgcctattttctagccttttgccaaaaaaattgccaacctctgctttaaataaaggagagcaccatcccccaactcacagacatacatacaattgataattggttgtctttaccccttctcctcccaaattaagatacataaaaaaaaatccataggactttaggggcaattagctgtctaccttgaattaacatcatttagcccttttgggttattttaaagccaaacattaaaccggatatttatattactttatatgaataaggtaggcaacttaaaagcacaaatagttgttcctataactatctcttacgtatgccaaattatgtcttcccacttacctttgttttccccatatagtcgggatttcattctttatcgctttcctggaaaacctccaacttatgtcacagataatggctatgaagacaaggtaagaagatgagtgaatgttgacttatataaaagaagttgaatgatgcttctggcttgcctggatattaaatcatttttaacctaattaatgaaaagcatagtctgaatgacaggtttctctgttactagcattttcctctctagtcagttaatctcagtgttgttagccctctaaacagacctgatcgtcatttctctgtgataggaaaaaagccaccccaaaccctaattggcttctcaatgactaaaaaggataaggttcaaactttgaagctaggcattcagcatcctgaaaggtcccaaaccagcttcattttcttccatccttattatgccatgcttccaggtattctgcttttcatactttgtgtctttgtatttgaaactttcccaatgcccctggagtcattttctcactttgtgctcccttagcagctcccaagtaattgtagtgtttattatattgtgtttgttttcatatgtatttctttcattatctgaaagtttcttgagggaagtgacagtgtctactactgcctggtaaagtacttgattgttagttgagaatactcagcagataaattgtttgtcagcatacagcttctccaaaaagtttataaaagaaaagccctttatcctgattattttattagtgaaatatagactacacaatgtttgagttctatatgtcttatttcacaacatggaacacaatttagacacaattctaatgatggcatgacaagactggagaccaggagaactgttaggatgctgttacgataatcgagggtgaatacctgaactaaggagaagtagcattaggaatagagaagactgaataggagataacttagaagataagtatgaacggggtacgttaattatctcttttctgagctttggggacaccaaaatgaatacagtgaaatccttgccctccaagagcttaagggacaatgaagacagacctgcaaagggttaattacagcaaagtggtaagttttataataaaaaaaattgtgctaaaagcataagggaaaaagcccttctttctgcttgagggagtttagaaagcttcatggtggtagtgacatttaagtggagtataaaagagtccatcaaatatgaagagcagtctattcagaggaaacactatatacagaggcatagaagcaagagaccctttgggagttaagtagttggatgtgaggaggatgatgctggaaagatagtctagagttacatagtaagaggtagagcaggccatgccaaataatttgtcttttcattgtacagaatagtcatttgaaactttttcccaacgttttattatgatgttcaaacatacagaaaagttaaaagaattttacagtgagcatccatatacctacccaccacctagagtctgctgttaacatcttagtattcttatcacatatctattcctcgatccattcatctgtccatctttcttttttgatatattttaaagtaaatttcagacaccagaaaacttgaccctaaatgctaatggaaagtttttaggcaaaggtgtgacataatctgaattgtttgaggaagaggagtgttaacttttgtatctaagcagttgtacatagcattgcttgagatgaaatttggatctttaccagggatctttaaactcccagttcagtttttcctcaacattgtattctgaaatttttcatacagagagaagtatgaagactcatgcagtaaacattcatgtacccaccacttagttcctacaattacacagttccatttataaatgtcttgtgtatcttacagagagattatttagctaatttagggggaacgttacccattgggaaccatgagaatacaaaaatttcagaccttttgagtgtgtacaacctacaaatatccatacatgtatacagagctaatacttaccagcacttgggtattttcatgtacaggatagtgcatatatatgtctgatttgggaatttatgaagtgggagtgtgtgtttatattgaaaagccaggtgcttttattttgtgatgctttgctttgcctaaaactttgttgctttatctcagttcacactcctaagattggcatcaggattgaatttttaaaaatgaggccgggtgtggtggctaatgcctgtaatcccagcactttgggaggtcgaggtgggtggatcacttgaggtcaggagtttgagaccagcccggccaatatggtgaaaccccgtgtctattaaaaatacccaaattagctgggtgtggtggcgcatgcctgtaatcccagctacttgggaggctgaggcagaagaatcacttgagcccaggaggcggaggttgcagtgagccaagattgcgccgctgcactccagcctgggcgacagagcaagactccatctcagaaataaataaataaaaatgattgtattataggcagtgaacattattaatgagccttctaaaaatattttagaacaaactttcatagaaataaatgtctaatattcactttggcatctttcatcttgtgtgttgacttaattctgcattctacatagttatcttcagtttcttaagtgtattcagctgaaatcgagccatcttcactcagctcatttgctctatctagatagaagtacatacttacattaaaaagaaaataaaattaagtcttgaaatgtagagtaagaaagtccccactcatcctcttcaattttatgcccttcaaagtaacaagtattggttctcatgcacttcaaagtaacaaactattaagtattggtgagtatctttctgtatcattttatttgtgtttgtcttttaaatgtaaatgggcccatatttaacattgttacttgttctttttaaatatccttcttagtaatatagatctaccccattttttcactagtttactgccattaattacatcccatctgcccactcccaaccacccacaagtatgtatgaattactttcatgttgggaaagccatcatgccttgttttgcctcttccagtcaaaatggaaattcttgccacttgaatagagaaattatatagttgtctgtcttctttctataagaactgcttattcatcactctggttaactggattcctttattccttaacaactgcctctaagttattaatatttcttagagttcccagttcttgtagcccaaagtacaaaggatttctctgctcaaaatctgctcactgttcttatgggttaataaactcttaaatgcaaataccccttgtggtgggagaaacttataacttaaactttactgtgagttacttaagcttgacacttgacttcagtactttgaaatggattattactgaaatagaattgtgatttccaaaaagacaagtgaagaataatagacctgggatcaaataactggattattgggagaagttagcccagggaagagtaggaagacagaaaaaaagaatgcttaggataatttttttttctgccaaggaggcttggtggcaacatctttccacagattgcagaatcattttgagtaactcaggttgctgataccttcaaaatggaagaaccttaatcactagggattatatcccttatataagacatttttttttgttttttttttaagagatggggatctcactatgttgcctaggctggagtgtggtggctattcacaggtgagatcatagcacactatagcttcaaacccctgggctcaagtgaccctcctgctgtagtagctgagactataggcacacaccatcccacctggtgaagacagattttttcaacaaaaattcagaaaggttttggaacagttatataaacaaatttcatcacatgcaacattttgactgaaaaaattttgcttaacaagcatggcctttgaattgttttgggaaaaaaaaacctctagggattcagggaatcagctcagacgttaaactgtcatttttgtagcctgagatgtgccttaattcattgaggaagtctctctagcagtattggtgctatatagtgtattgatatattgctattcagttaaatggataactttcgaaataattgaataaaatccctttcctcccttagtctgagtttggagtatttgggtatttgacctaatttttccagtcattcttggaagttagctgggtcttttggcatctgttaggctttctgttatgttcaataactcaatttctaagtgttcctttttttttttttttttttagcaaatttgtaaatcaggacttgtttggtatattaatgtgattgaggctcacagtgtaaccttagtagtgattttaatcttggcatttaaaagtcactgccaagaaaatctctatgaggtacaggttgcatttccttatatttagattttaaaaatcactttaaaaaaattcagttagttatcagttactgactactgactcaatttcaagttaattatcatcttaatttcatggttttaagatgtgtaacattcacttaattgttctgtgtgtttttctttagattctactctgctactcaagtagtggtcactatgattctgtgtactcaaaacaatttcagtcaagtgcagctgtttgtcagggtatgtgaaggctttataaattgtgggtgtgatttcagatgacttgttttcactcagggacccaccatgaatagcccctttaaaaccttgttggtacctatttgcacgcaggattatgactattttcacatagttaatataaatcttattttgacaattggaattttgaccattttttcttcagctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggtaataaagggaaaggggatatcatgataattatgtttcatacttctgtgcataatcatttgaaagtggaaggggcctggcaagcttatgagttaggttacatattcacacgtacacatatgttaggatatatatttttaatggggggagagttttaccaaagagatgtgtcgtgagatgcccagacttgggggttttgttcaggtccgttttgtattgctagaagaaacttcagaactatctaattacatgattctcaaactttagttgtataagaattatagtgcttgttagaaaggcaggttcctgggcctactgtcacaaaatttgaggtcaggatgggaccaggaatctgttttttaaacaagtgtgcctaagcattctgatgtaggtaggctgtggatcatactttgagaaaatactgattctaaagtagcaccatcattttctaggtaataactgaggttagttgacacatccagccagtagaaaatttctcagtgtaagttttgggagtgttttagtgtctgcctttggtatgcactgtgagtgtgcctctgaggaaacaactgttgaacagctctagttgaacactttgggtttgaaataataaagtacatgtcttatatttcttcctaattcctagttctgcctgcaaattcagataggtttggtgctaggtaagtgtcaccttgtgttttttgtcttgcagttctatttcttggatgtttaaagcttacaattttttttctttttttttttttttttttgagacggagtctcgctctgtcagccaggctggagtgcagtagcgcgatctcagctcactgcaacctccgcctcccaggttcaagcagttctcctgcctcagcctcccgagtagctgggactacaggcgtgtgtcaccaagcccggctaattttttgtatttttagtagagatggggttcacaggtttagccaggatgatcttggtctcctgacctcgtgatccatccgcctcggcctcccaaagtgctgggattacagacgtgagccaccacacccggcagaagagggtttttaaagcttatttgggactgccaggagtggcaaccatgtattagggtaaaggttgcttcactcttcactgatcacttgtcttaaggacttcaggcttacggaaactacagtagtcggaaagcaaggtgtattagttatgttttgctgtgtagcaatgttactacaaacttgccagcttaaaacagcacatttttctcacaatttatgtggattaggaatctggacacggcttagctagatcttctgctgagtgtctcataagactgtaatgaggatgttggtcaggactgagttcttatctggagctttgactggagaaaagtctacttccccactcatggttcttggcagcattcagttccttcgagctataggactgagagcttcaagtttttgctgtcagttggcagaagtaaccctcagctctgctacattgcagtggtgaatatggctgtttgcttccttataggcagcagaggagagagagagaccagtaaaatgaatgaggcagggatcatagggatcaccctaagagtgtgttctcacaggagttgtaaaatataggaggtaatctgctaagtatattgtagcacatacttataaaaacgaagcataaatgcaaatgttggaatgaaaaagcatttgccttatttttagaactgagttaatttaccactaggtggtggtgtagtcattaggcttaacataagtaaattcttcatttataaaaagctctttgctctaaatcttttgaattaggatggaagagtggggtgcctgctacaatgctgaaaatataccagagggctacaataaaggaacagaagaaacaaaggtttgatattttctaaggcaaagaattttcatagtcttggcttgcagcatcatgacttaaactagttaaagtcagatattatattctagttatatgggttgagggaggagttggtcattttcctttgtgaaagtcttacctatctttaaacttcaaatgcatacttaatgttctttgaattcttatttttacagaattttagatttttcagaacaaactgaacacttcagaaatttcaagagcaatatgtttttaagttaaatattacaaacccaatatttagtttgtaatcagtcttctgacgctaaggtttttttcattaaggaatacaatgcctatctttattttattcaaactaggtgataatcatggtttaaagttagagaaacagaaatttcaccatccgtataggactaaaatcaaataggccttcagtttgaggctagctaaataagtcaaatactattatagcaatctctgtgtatacctgaggtgcttataattttggaatagtattgaatatggtgaaattctaggaaagcagaagaaaaatggtagttcctttggaaattttaacaggatttgaccataatgaagtaaccttcagatatttccaggtgattgtagagtacagaaatattgcacctccatgtgtatatcatgataacacttcctgaatagctctgaatttttaatcctggtttgtgttgcattggtttatatgggatgtgtcctgagtcattgccaggtttagacattatttcccttctgccatctaaaaccttttagattacttgcattttgctactttagtctcctgatttttaaaatatatggcaaaatttattgtgcgatttatttcttgttttaataaagaacgacgtggttttttttttttttaagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagactaaggattgtgagtttgtagcatgattatttttgttttagtctccagaaaatccatcaaagatgcccttcccctataaggtgctcaaagccctggatccagaaatctatcgtaatgtagaatttgatgtttggttggacagcagaaaaggtaaagaaatatcaacaggatacttttgaatcctgacaaatccaggagtataattttgcaaattatggtgaacatctcttataagaaatactgttataaaaaatagcctgatgctttttatcttactttatatatgatttaaatccaaaggagggaacatagctttagaagtgggagggatcttttaaagcctgatgtttgcctgggacttcaactttgcaaagactgtgtggagacaatttttagatagcattaagaaacttagtgactgaaaacaagctcatcttaaattccaggtgttaagaccaccttccttgataaatgagtaggttaggcctgtgggtcaaatctgacacaccaactgtttttatgtggtctatgagctaagaatggtctttaattcttaaatggcagaaaaaattaaaagaataatatatcgtgacacatgaaaattatataattcaaatttcagtgttcataacattttacagcagagtttgagtagttctgagagtcttatggcccaagaaactgaaaatactatctggctctttatggaaaaagtttaccaacccttgaaaataggtcattgtttctctccttataagataactaaagtgatcaacctaggccttaaagttttgccttcaagataagcctttagtatttcacattcaactccttgaaccctggtaaacctagctgtagttaacaatctagaatgaggttaagaccttgggaaacacagtaagttgttaaaaaaataataggttgatttgagaagctgaataatgttactttcaaattgtacctcgttagtgtttgactatctctgattacaaactcccaatttccacctatttgttttttaaagcacaaaattattctggcacgtctttttaaattgactgcagaaataactcatccagaatgatagaatcgccctttgggactttacccctattttcacttatagtggtagcgttgtcaaaggcactacggtaaaagtaaatgaggaaattaaatgatataggaaaggaaccagtttagttgagcttgaatcttcattttcttttaatagaacttcaaaaatctgattacatggagtatgctgggagacagtactatttgggagacaagtgtcaggttagttccttcttcaagaatcagtaatttttttaagaatgtgctttttgtcatgatatgagttgaacaagacttatttacaaagtactagaaactttttatttatatttttaaagagatagggtctagctctgttgcctaggctggagtgtagtggcatgatcctggctcactgcagcctcgaactcctgggctcaagtgatcctcctttcctcagcctctctagtggctgggactacaggcacataccaccatgcctggctaattttttttatttttatttatttatttatttatttttattttttttttgagacggagtcttgctctgtctcccaggctctggagtgcagtggcatgatctctgctcactgcaagctctgcctcccgggttcatgcctcagcctcccaagtagctgggactacaggcgcctgccaccatgcctaattttttgtatttttagtagagacgtggttccaccgtgttagccaggatggtcttgatctcctgacctcgtgatccacccatctcagcctcccaaagtgctgggattacaggtgtgagccagtgcacctggactatttttattttcttttatagaaacagggtcttactatgttgcccaggctggtctcattcctggcctcaagtgatcctcccaccttggcctcccaatgttgggattacaggcatgagccaccacacccagccgaaaaaaaaaatgtttctttaatgtctgtgttaaattttaattacaaatttagtgattagatgtaaggttctttcagtatgtgctgtctccattgatccagactggcagtgttgatacgaattactttaaaaagtagacactgaactccatttggggaaaagtggtattttgtttggcattagctgtatctgtcactagtcttgagactagaagtattctcttttcaggtttgcttggaatcagaaggaagatattataatgctcatatccaggaagttggaaatgagaacaattcagtaacagtcttcattgaagaattggcggaaaagtaggaatatgataatttgttgaattactgaaatctttggttcctggttccatttcgtaatattaaattgagaattaccaggatgctagtaagagaaccagaattgtatctactgttggcctaggatgacttatcttgaattataaaagcatgtgctgaagtatgaatcaatatagatattagatatgtataaaagttttcaaatcttaagacactagcctacttattagaaatattaagtacaacagaattctgatacaaaactgttcatagtaattgcaaagttgaattaataactgagcctctgccagcatgaagataagctaatctagtctttctcaaactttaccatgcaccagaattacctggagggcttgtgaaaacacaagattagtgagcccagtctctaaagtttctgattcagtaagtctgaggtggggcccatgaattttaattttggacaagtttccaggtgatgataatgctgctggtccactttgagaaccattaaatgaggctgtgctgctctaacaaccaaaacatttcagcagcttaaaacagtaaggtccttcctccttcatttagcatgtccatagtgggtcagcaaatgggatccggttcaacagagattctattttaacacgtgcatccatgatcatagggaataaaatgagaacaaaccacttgctgaatcttaaaatgtctcatactttattaaccagagtggtttacattcccaagcctcatgtcaatggggtggggaaatttaatcctccaaggaggcacagcaaatatttgtgaactaatacagtctaccacagtctttcttctgaaatgtcatcggtactagaaacagcagtgaaattgtacaaactactcttaagttttctaaactaataaaaaattaaacaaggaaactggtgtcaaccaggttttaatagaatacacttgaagtataaggggtgggatacgtgtattgaatgaaagttaagtctgtgttgcagtatcttcatggtgatacctttaacttttaaggcatgttgttccactggctaacttaaaaccagttacccaagtgatgtctgttcctgcctggaatgctatgcccagtcggaaaggaagaggttaccagaaaatgcctgggggttatgtcccggaaataggtttgtatgctaaaggttgttattttgtttttcccttcctgtacctgcttttacttacctgcattgtactattttttaaatgtatgtcatatgtcttgttgtagggtagggtttctcaactttagcattactgataatggaatggatactacttcactgtcgggggtttgtcctgtgcattgtagggtgcttcatagcatccctggcttctatccactagaaacaaaaatgtttccagacattgccaaatattccctagaggagggagaggcacagttgtccctggttgagaaccatggttcttaagggactttgtgtaaacttaagcactcatatttgagagctaaaaagaaaaaaatgatcttgtggagatgagtagaatgatggttaccagaggctcagaagggtattgggggtgggggataaagagggattagttaatgggtacaaaaataggtagtaggattaagatctagtatttggtagcataatagggtgactgtagttaacaattgcatatttcaaaaaaactagaggactggatttggaatgttcccaacataaagaatttgtaaatgtttgaggtgatagatatcccagttaccttgatttgatcattatacattgtatgcttgtatcaaaatagtgcatgtaccccataaatacgtactgttctacacctataaaaattaatttaaaaaacttaagctgacatggatcttaacctgagggggaaaaatatttcttagagacctgagggggaaaaatatttcttagagaactaggaaaatacctcatagaagcagccagggatattaacaggcataatttattagagaatagtaatgtgtgtgattggatgactcggagtttttggggtttttgtttgtttgtttgtttgagacagaatctcgctctttggcccaggccggactgcagtggcgctatctcggctcactgtaagctccacctcccgggttcacgccattctcctgcctcagcctcccaagtagctgggactacaggctcctgccaccgtgcctggctaattttttttgtatttttagtagagatggggtttcaccgtgttagccaagatggtctcgatctcctgacctcgtgatctgcccgcctcggcctcccaaagtgctgggattacaggcgtgttttgtttttttttttttttttttttgagacagtctcactctgtcgcccaggctggagtgcagttgtgcgatcttggctcattgcaacctccacctttcgggctcaagcaattctcctgcctcagccttctgagtagctgggattacaggcgcacgttaccacgcctggctaattcttgcattttcagtagagacggtttcaccatgttaactaggctgtccttgaactcctgacctcaagtgatccacccacctcggccttccaaagtgctgggattacaggcgtgagccaccgtgcctggccatggatgactcagtgttttgatgacctatactaacctgcccatgctggggatagtgccgagatatacccattgatacagaaattacctgctggttttgtccttccaaataaaagatctagtatatccttcaaaaatacaaaaattccctccctatgtttatttggtttgttcctaggggaagcattggaaagtttaaggcagtgtggtggtgacagtacactgggccttttgctttgattatgaagcttatttgctacctctttgtttgcctgaaagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggtaagacattgacagatttgtattttcatggtctagggaaatatgaagcaattgaagagatccaagaagatagaatgccatcaagatgagggtctctgtgacatacagactgtatttcattaataatagttagccctaatgccagtattgcagagagcagagctctttctagttgaatgtttttagaaagacagattagttctatttaactacagagactgactacttaggtattagtgaatagagagttctagtttcctttctctttattcttaggaattcatctcggtttataaacaggcacaacatgccgggccctaaagttgatttttacccaggcccaggtaaaaggtgctgccagagctatgataacttctcttatagatctcggtaagtattgtgttgaaagtcagagaaaattggtaagtctgatttcattgctgaacattaatgttttaaaaagtgtcaactttgagatatttgaactgttatttagaaattaggaacaagttactatatttcatcatttttacttttttattatttgaaccacttaagttcatttagacgtagtcaccgccagatgagttgtgtgaataaggagtcccagtatggatttaccccagggaatggacagatgcccaggggcttggaagaaactattactttttatgaagttgaagaaggggatgagactgcttatccaactttacctgtgagtggatcaatgctttactcaaaaagctgtttacttttttcatttatttttttgaagtaaaggcaatgtggataaattttagattttgtacaaataaccaaacaaagccttttctggaaaatgaaaatgagaaaagagacattttctcccagctgttcctagagaagggaatagaggtagacttgataatcttgcctatagagtatgggttaatattttctattttcttgatttttacttcatattttttgtattctaaactgcatggaaaacatttaattacagagttctcttacaatagcagttcacattgttaggctagtttttaaactgccttttaaaacatccctctagcttttttttctgactatatagtgagaactgcagtgtgtgtgtgtctctctgatacagaatcatggaggtccctctacaatggttcctgctacttcaggatactgtgttggaaggcggggacatagctcaggcaaacagactttgaatttagaggagggcaatggccagagtgaaaatggtgagtcaattacagttaaatattttttaaaagattcttgtggcattagcacatcaggccagtgaagtagaccaatttggttttggcgtctctctctgttccagtagcttagttctgaaagatttatataagttcttaatgcttgctgggtttttgaatatgtcctggtatttctcagaagagtagacttctatttcattaggctgctacattgttataacttgttttcagctctctgcataggtctttagtgagttttgacttggtgtcagatatcagtatggaaaacatctattcgttgttagtagggcactattgatagttgtcctcaccatttgtatatgttaggcttttcgtgtgactggctattattttttaagactactatgaagtaactattcgatagttacttcatactatgaagtctatttgatctataaacattactctttattgaaccctacgtgatacccactctactaagtcattatattcataatatagtccttcgtgtgctcttctgaggaatgtgctgtccctattttacatatgaggaaattgagattcagagggtaaatgacatggctaaggtcatatccttggtaaatggcagagatataattttttgtaacttttattgagatataatttacatatcatacaattcagctatttaaagaatacaattcaatggttttttattcagagttgcataccatcaacacaattaatactaggacatttttatcaccacaatagagaaatcctgtgcccattaggagccattccccatttgccccaacccccagcccttggcaaccatcagtctgttttctgtctttatggatttgcctctgctggacattttttataattggaatcgtatacacacacatagccttaacagtttttatgttgactcctaccatggaatgtgtttatttttaccttgttacttttaaaagatactgtatatccctattgaaacaattgtggagcattgagtggcttaaggaggtgtcaggcattcctaatgacttgacttatgaataagttccttattttcttgtactctttttttctactagtgtagaaaaaaaatagatatttttaggaatttaatgagtaaaaaaatctagtgcaagaatgatctgtgaaaactttgtacgtgtgtgcatgcgtgtgcttaaggacatttactgtctgctctcttatttagatgacccttttgtcttttagctctatgggtagtgtggcatatttgaaataaccaaatctttgctcccaccttaaatctggaggagtttcatgcgtgtgtgtttgataagtggtgtgtttaagaatcaaatttagtttagaactgcgggtttatatttggtggaaaactgtccgattgagtattgactttctctgcatttcagtggtacagaaatcttaaaagtacttcagtctactgagccatcctttgaggacacactcattttacatgtattacttacatgaaacagattgaaaaacagatgaggcatacatgttcccttaatgtccacctaaggaaacagtggattatactcatactttatagacaccattgagtatttagtatgtgtaaagcactatgctaagttactttcacttccattaaccatcctcaaaaggcctatgagctaggtactgttactccattttacagtgaagaattgaggcacagagattaaataacttgcctaaagtcatgtagttaatcagaattcaaatctaggcagtcctcactccagagcctatgtgcttaatcaccacactgtagcctcactggaaaaattggacacaactgagttttcacttctgcctgacctctaagagctaagtggattttcagaggagaaatttgtacagcttacagctagtctgtggcttcaatatctgttgactagtgtgaaagctcatatcacttttcaggatgtatgcattttagttttgaacatataaccataaaactggtggaaaaagcaagtgctggccatttggctctgctgagctaaaaagacctatataaacacatttcttctgtcttgtcttttttccccagggcgatatcatgaagaatatctttatcgtgcaggtcagtaagatctagaagtgatctggcattcatcattgtttatagaatttcaagctataaaataatgctcattttttactttggctatattctctagagccagactatgaaacttcaggtgtttatagcacaactgcatctacagcaaacttggtaggtatttaataatagcaaagagttatagctcctactatgtactagggcactgttaagagctatacatataaatgtatttaaatcagaacaaccctgtgaggcttagtatcattctcattttgaagatgaaattgagacagaaattaactcgtgttctggaactaatatatttagagatattctaacataggcagtaatgatcttttagaaggttttattatgatttttttattagaatggatgatacatctcactcaatataacaaaagtttgcttctcctttatgctacatgtctagtagaggtctgtagaagggcttgctcaggtacttaggctgatggaaattcatccacaattgccaaggcaggaaataaaattcggtaaatggtgcactggctcttagagtttccactagaggtgatacatgtcactttcttttccatttcactggccagagcaggtcccactgaagagtcttaacttttctgtgctggaaggcaaaaagaaacatgttaacagcgctaagaactatatcattcaacttgccctccctctcataggcagaatacttgtttctgtctcaaaggaggcatcctaaaatgtcccattcagtgtaatcaaactcaaagcctaggatttctgggctatgtgtagtacttgttatattgggtccagatgtagcttcttgtgatcttgagacttaaaaccaaaaatacagaggttttattttttccccctccctccccagtttacagtgctgaagcagggactgaaatttctattcataaagggagaaaaaaacagttattggcctgtagcaattctgagaccttcatgggcagacgttgtaagggcccccaacatactcatgggactcttccctggaggaactctcgttcattttctggggctcttggttactcccaaggcccatccttccttggcagtgtttggagtaggcattggagaataatccttccttggcaaccgagcagctttctaagcttgctacttacagaagattggaggcccaagggtggttttatctcagttgaatggttttagttctggctcgtgatttctttggctgtaagattaatttattctgcttctgtttgatttcttttggtttcatgtaccaatagccatactacagttcttttctatagatatactactaagatttgctataattctttgtggttttatccttatatttctgtctatttgattgcaagtggcttgagtttatcaggcactgatggaagagccatgcattttggacatttttctacaagccattttgttgaagtgcaaggatttactaggtgttacatccttagttgaactctagctttgagacatcttaatacactcgggttttaaccaaagagttcattcttgctgcgaggtcgagttttcactgtttgtcgttgttcaaaccattcatcaatattaccttttatagtttagggttgaaacagttgttccttcaaccctgtgagtccctgtatgcaaggaatctattccctttcattcctgcctgcaaactactaattctctcctacatacacctgtcttaaaataacttgctttagacaatgccaacagttatcaaagcacaatactaacatcatgtcttctaaattgcttaccctaagagctacatgttcataatctccttctcaattaggattttgttatagccgtaccctacttctagttaccaatttctgttttagtcaagctaggttatgctgcagttaacaaccccccaaaatctcagtggcttaactcaggaaaagttgttcttgctaatgttatatagttcaatgcgagttggcagcaggctgccagactatgactgttcttcatagtcacccagggacccaggctgatggacacatgccatcatgatcatcacagcagggcaaaagatacagaaattgaacactgacatttctggtcatattttattgaccaagtaacatggtcattcttgactttggatggagctgggaagggcaatcctaccatctattcaggaaatctggaatatttatgaagaacttgaataactaccttatattctctaattatgactaaactgtggcagcttcatgtactaaatttttgtttttactgtttagacaatataccttaggaaggagaagaaaactctgatacgtaattctctttctgttctttctccttcccttactttgctccttccagagaaagttttttcccccatttcctgccaccattactattctcatatcatgtgcttttgatatcacctcttgaagtagccaagtaagaatcttaccacaagggatgacaagaatactttttttctgttccttcaatttcacttgtcacatgttcctttttgttctgaatttaaacaacctcaatagctttcaatctcttcatatgttccaagccctctgcccccatcaccaaatccatagcaaatttctattgttgctaaaataaaggataaatgtcttcagaattatcagcatacattaaaaaaaaactctttgtctttaatttttaatttcaataggttttttggagaacaggtggtggttggttacaatgaataagttctttagtgatgacttctgagatttcagtgcacccatcacttgagcagtgtaccactgtaagcaatgtatagtcttttatccctcacccccttcccaccatttcccccgagtccccaaagtccattgtatcattcttatgcctttgcttccttagcttagcttccacttatgagtgagaacatatagtgtttggttttccattcctgagttacttcacttagaataacggtctttaattccatctgagttgcttcagatgccattattttgtttctttgtatggctgagtagtattccatggtatatatgcaccacattttctttatccacttgatgattaattgatgggcatttgggctggttccatattcttgcgattgcaaactctgctgctataaacatatatgtgctagtatctgttttgtgtaatgacttcttttcctctgggtacatacccaggagtgggattgctggatcagatggtagttctacttttagttctttaaggaatctccacactgttttccatagtggaaaacagtgtacacagttgtactagtttacactgccaccaacagtataaaaccgttcccttttcaccacatccatgccaacatctattttttgatatttttgattatggccattcttgcaggagcgaggcggtatcacataatggttcttatttgcatttccctgataattaatgacgttgagcattttttcttatgtttgttgaccatttgtatatcttcttttgagaattgtctattcatgtccttagctcactttttgatgggattgtgtttttcttgctgatttgagtttcttgtagattctggatattagtcctttgtcgaatgtatagattgctagattgtgaagattttctcccactctgtgggttgtctatctgtttactctgctggttttttctttttgctgtgcagaagcttttttgcttaattaagtcccatctatttatctttgtttttgtccaacgcaggactctttgaataaagatttccaggcaaagccttctaagaaatcatgaacatttatttctacttcttatttccatgtctaacactcaaataaatgtttctctagaagcatttggtattcacttgggaacttctgagccagggcaaatgtttgctttttggcaggggctttggctatacttgaacacagactttggaattgtccatgttaagtggggctcaccttttcacagtaaggtactttttgttgtttgctgtgattacctttccctgttctttctgtgctcttactaatgtaaccaatctctgctggtagagtttttgctgccatgacagtctatcatgcatgagtccaagccattcaaaatcatttttacttttagaaagacagggtcttaagccagaggagaatgatatttgaatcttacaatatctattaaatcccgcttagataaaacgcaactgaataaccagtttacccttgtaccaagctacatattcagatagaatgccttttttttttaagcaaaactattgttggtcctatggtgcttcaagcttttaaggcaaagatcactgaaagactgtttagatttcaattatcagttacattttagtatctacatcaggacttgagttagatgtgttgaggatttctgtagatatgtaacaaaacagtcacctacatcacattttagagtgataacttttagagctttgtcttaggagtcacttccaaatttgaattttttcaggactgatcactttcatatagttttaaaatatgttgaaacaaagttattgatgtgttgtttgtttttttatttaactatatttttgtattaaagtctcttcaggacagaaagtcatgttctatgtctcctcaggacacagttacctcatacaactacccccagaaggtaatcctcatagtgttattaagcagttacaatggcctgaacacagaaaaatgaatttcctcttttcatttaccttcatcatacttcaaagcaactgcttttgttcctttaggtattattgtaccttctggtgtctgacacagtgattagtaaattaattcaacaaattattgagcatctactgtgttccagacactgttctatgtgctggctttagattactcatagtctcctgtgagcctcttttatataaagagtgagttaatctaaattacccatcaattctgtctcattaactgaaacttaattttaaagctttcctgtagaatggagagtcagcattataaaaaggtagctgaaaccataggagtaaacaagatcatcctgggcaaaggaagagattgagaagggcatctagaacagagcccatggattatcaaattttagaaaatgggcagagaaggaccatccaagagggaggaaaagcacgagagaggaatattatggaagccctaggaagagaatgtttcaaggagcagccaggtgtcagttgctgccaagaggtcaagcaacataagacttaacaaaagtctactaagatttgttgacatagagaccactggtgactttgaatacagtttcagagaaccagtgtgggtagcagccacactgcagttgggtgggaagaaaatggagactcccagtgaggacagtatgttcaagaagaatctgttaccatttactgaatatctttctgtgcacagccctgtactgggtgctgtggaaaaatagtttattctcttaaggagctgtggcctaagcagaaaaaaaaaaatacagtcttacaatgttataaaaaatgcaaggcaccttttctctttaaaaaagagaaaagtgtaggccagatgcagtggctcatgcctgtaatcccaacactttgggatgctaaggcgggcaggttacttgagcccaggggttcaacaccagccttggcaacatgacaaaactgtctctactaaaaatataaaaaattagctgtgcgtggtggtgcgtgactgtagtcctaagctactcaggaggctgaggtgggagaatcacttgagcctggaaagttgaggctacagtgaatgaaatcatgccacttcactccagcctgggcgatgggagtgagaccctgtctcaaagaaaggtgtttgcttgtgtggggcaatatatatgcatgtaaaaatgaattacaaacctttggaataatatgcaggaagcccagaggttaactgtttggggagcgggcaactaggcagacaggacagggcttggagggaaactttccattgtatacgatttaatacttgattttcaaatcatattaatgtattacctttttagaaataaatgaattaaaaaattaaagctctcaagtgacctaagatcttctgaaagaaataaccttcctatataaggtttacataaagattgactttcagtgttttagttttctaaactaattactattttctgaagtttaggatcagataatctactgtttgaaaaaccaaacttaagagttttgaactttcttccacacttacagatgatgggaaatattgcagcagttgcagcttcctgtgccaataatgttccagctccagtcttatctaacggtgcagcggctaatcaagctattagtaccacttcagtttcctcacagaatgctatacagcctctctttgtatctccacctacacacggcaggccaggtaggttattagcagatgcttactttggaagcctcttttcctattcatgaacatgcacatccagctgttctggtaattacataccattactttaatttccagaattaaatttatttaacctacttaattatgttctgccattgaggaatccatgagatttgagagtcagggattcaagtttattcttgaaaatttcgtgctggtaagattttatacctttcattttgctacctgctgaattaggggacttgtactagtttctcaaactttgagttaagttttatcatataagagtgaagatagcgatgcttctcaccttatagcaaacttttcaggaatttattctataaaacacgttcctttgtaatgaataattgtcctgtaaatatcataataaaagatacaggctctggaatttaaaagatctgggttagaatcctggttttacaacttattgtgtaattttgcacaaattattgaagctttttatctgtggcttgggggcactgatagtaccaattcatgaagtggttgtggacttttcagtaagttaataaaattttaaattatcagcagacttctaggaaggtggtggcaacaacagcattagcttttctgagtctcaaaataaaaatggaaatagtgaagtcaaaacccatgacacctacaaaaatctaggtgacaaggtatccccatgaaccccaggatttaagcaggtagggacaaaccactagtcacaagacctgcatgctatcagggtctatgagggagcaagaacatagaagcattgaggatgttgtcttatgtacctgagaattccaatgaataagaattcactgaaaagtagggcagacaatttggaagcagcagccaaaactgggaagggatttggtctctctaatactaggtgagtgcatgaggcacatagtagaaggacttgaagggcttagaacagtttaacctctaactcttcaaaattgacctgccagagttcccttttaggacagtattcctcactgggaagaaactgctaagagtggaatctgaattgatcaggatagagaaaagagcaggtcagggaaaagaacaaaagaaaaggattaaggtcaaatgctacacaaatatatcttaaggaataaaaagcagaatatccctacagacaatgaaaacatgttagaaatgaaacactaaacagatctaaataaactaaaaactgtgacaaactatttcaaaatgagctaaagatattaataatacaaaacattaaagaataacataaatcagaattagaaaaactcacctgaggtgatagaactcaggaaagaattataaaggggagaaggtcattttagtaatggagactaaactgtaatgagcttgagcaaatacaggttgagtattctttattcaaagtgcttgggaccagaagtgttttggacttaggatttttttagattttggaatatttgcattatgcttgttgagcattcctaatctgaaaatccaaaattctccaataagcatttcctttgagcgctatgtaggcactcagaaagttttggaatttggagcagtttgaatttcagattttcaaattagggatacccactctgtatgtacagcagataatgctttaagagaaataagagtgctttaggctttaaattttttttgtttgagacggggtattgctctgtcaccaaggctggagtgcagtgacatgatcatggctcactgcagcctggatctccaggtttcaagcagtcctgctgcctcagccccccagtacctgggactataggcacacgccaccacactcggctaattactgtgtttttgtagagacagggtcttgccatgttgcccaagctggtcttgaactcctaggcttaagtgatccacccacctcagcctcccaaagtgctgggattacaggcatgagccaccacacccggccataaactttagaaaaaaaaaaaaatgtaagaagagggaaatctaaaattgaaaaaaaaaaatgaagataaagatttaaaagcgacatatttgaagttaggcaaatgagatcaaacacagaagtctctgaaaaaaccaaagtaaaggaacaaaataatactaaaagctataatttagaaaactttgctgaagttttgtattaggttgttttcacactgctataaagaaatgcctgagactgggtaatatataaaagaaagaggtttaatttactcacagttctgcatggctgaggaggcctcaggaaacttgcaatcatggcggaaagtgaagggaaagcagacaccttctttacaaggcaccaggagagagagaaagaccaggagaaactgccatttataaaactatcagatctcatgagaatttactcactatcacaagaacagcataggggaaaccgctcccatgatccagccacctcccaccaggtctgtcccttgacacctggggattacaactcagtttacaattcaagatgagatttgggtggggacagagtcaaaccataagtttaaaaagttttaaaagtacatacttgaaacagcaccctgaatacctgagaatattgacccagagcaataaacagcagaatattctaataaagttgctagagttaaaaagtcctaagtatctaagagtctatggcatataagagaaatacaatgataatcatcaaactttgacagcattgctttatgctagaagacagtggaataacatttaagatactcaaggaaagaatatgtgaaccagcaattttgtatccagtcaaactgattttcaagcacaaagggcaacatgtgagaaaccaagaatattcttcccatgagcccttcctgatgaatctgtgagaactgtgctgtcaagcagggtaatcactagccacgtgtggaaactaaattaattacagttaaatagagtaaatctgtagttcctcagttgcattagccacatgtggctagtagctactgtattggacagcagagatatagaatatttctatcatcacaaaaagttgtattggacaacagtgtactagagaatgaactttgagttttaggctaccagaacaattagagacattgttctggtattgtgtaccagaacaattagaggcagaacaattagagacataagacgtgatggtaagtattaaatacatagttacctgtagaagtaagacaaatgagggctgagaagttgagactatactatgtaatagccttatgtttggagggtgtagatgtagttatttttttaaatgatagaattgagagaatatgggcaaagcattttttcatgctctcagtcacatcagattctttagtttagatgctcagaaagttattccgagactatgtaatgtgggctaaagcaaatgagtaatggtgggatattctaattttatcccgtgtccttgtgaaccaggattcttagtgtggaaaaaaggtaatgcagatgttatagaggttaattaaaagcttttatagtcttgaacttgaattagaagtatcagtatgaacttgagatattttatctttaaatatatatatatgtttcctcgctgtgtccactgaaaggcctgaaaacaataagtatccctagcaccgagtttgtggtcttaaaataccatttattacttttaaaaataaacggctctgtggagaaatggctgattccaggtctgagcaggaaatgttcaagatgagcctggaacatcttgtcataccagatagcaaggaacatatcaaagagtataggcattatgtcagaaggactcagaaaccatcacaaagagagattcccactggccaaagatggaacaatttgagcctcaacaaagatcattgcaatagattggaatataccaagtatgttgaatataaaagttcttagtgatattttaaaaattgcttactttaagaggatgataggaaatcaattaattttcttgaaaactggaacatgaaataatcaaacatttattctgccttccttatatgaactatactactgaatagccaaatagatgaggggaagtatctttttgtaatagtattctaactaatcaattaaaaagtgaaaataatttttcagttcttattaaatggatggacattaaacatcagtagctactaagattgcaaagtcagtcaaacattagctatggatgttatagatgtcccaaaggaatcagtcctgaatttgattcagtctcctggatctagctgcctattgacaggaaataaagaataacatgttggattgcagcatgagtatgtaatctgcaaaatccagactatgggaagcttgtcaggtcaaagggcccaggttctttaaagcagaacttgtcaggaaatgggtggaggaaggaccaatagattaagacattcaagaaatatccaattttttaatggatgagactaaaaaactgctgttcaaggatgcacatttgagtgacaaaactctgaaaagaccccaaggaagtgattactattaaagtcaaaacaacagttggttatggtaggagggaaaagtatttataggcatgggtagtatccacattaaaataactcattaagcagtatatttgatttgtttgctgtatctgttttatttataaaaagataaagtgagcagggcatggtggctcatgcctgtaatcccagcactctgggaggccgaggtgggcagatcacctgaggtcaggagttcgagaccagcctggccaacatagggaaaccccatctctactaaaaatacaaaaattagccaggcatggtggcacatgcctgtaatcccagctactctggaggctgaggcaagagaatcacttgaactcaggagtcggagtttgcattgagctgagatcacatcattgcactccagcctgggcaagagcgagactttgtctcaaaaaaaaaaaaaaaagtgcttagcacagtgcctggaacaaaaacatacaataaatgttaatgatgatatatttttttcactggaaatgttaatgtagacactacttttactactttgtgctagttgtaagggaaaatgtttgctgtctgcttctagcagctgtctgagcttaaattcaagtgacagatgaagcaagcattgtaatgttttatttatgtggaatcattgaaagattacgatttaaatgccagatttttctaaaaatgcatactgccttcatttatttgctttttgttctctcagtcacttaatgaacctcaactatagatcttctttactagatctggctgatttttagttgctctttgtcattcttgtcaatcctatagatgaaacgactgatttttcccactttgttcttcatatgtctctctggcaggccccttccatccttaagtgactgctaatctgccaggtaacaagatgtgatgattgccttcaaatatgagtctccttttaggcattaaatcctgtcaacttcaaactctgggtttcagtaaatgttcccaagtcttttgccagggctgggatcagtgactgtccctgagtgcaaaatttaatggaatgccaaaaaaaaaaaaaacagtaatcaagataaataacactttaattcatcatttttaaaaataaagattaatataaaaaatttgagaacaaagtatcaattgtaaataaagacaggatctgtgggtcaggtttaaggtgcattgagtaaggcatatacccttggggtcatacaagtacagggttggatcctgtctttactgaaaattttgatgttgtattcataatagctttctttgtattagttttggtagccccttaaattttgcactggagcatctcaccacaccttggccttggccctggtctgtgatttctagagaagcagcagtatcttattgtatatatttatgttctcttctgaagtgtcctgaagcagactacagctacatggatgggggaaatcagcattctgaatgcattacgttgatttctactagtattttagaagacgtttctataattcttgagacatcccttgaagtgtatctgttaagcctgtggagctcttcttaagtctgaggatgagaagctcatgcatctctatagaaacttgaaattgtaaaagcttttacttagagggtttattgtaatactgtgcatttataaggaaggtgaattcagacaaagtaacctccaaattgtgtctactcttgattctttcaggcccgtgagaatgtatttagccacttctatgtcttggtttttacctagtgatcataatcacattctactatcttcagctaattgcctttctccatttgcttttttttaaaaaaatggcatgatacgttttcagtgctagtttaaaaggaataagagcagagctttgttggaggagccattttatttaaaaaaaatctgtatctagaacatttggggatattctgaaaattaagttcccctcccaaaactgtaaaagtagagatttcgaaatatatgacaaaactccaaaacagctagttgagcaagctttaaaaacttactgtttaatttagatacagtataattcatttttttggtgcccagttctgtgagctttgacaaatgcgtagagttgtgtaaccaccaccacaatcaagagataattgcatcactcctaaacagttgtttatcaagttttacatcacctgaagacacagacctattactgttagcctgtaaatgtacaaaagataagatgagtatattgttagtactggtcactaaatggaaacaatgtggattatgtcttgctaaaatatcagaataacaaattcagcttgtgtgaattgttcctatgctcctatgctaaactcagtgtgctaaaactctgactttaaacatttatagaatgataagactaaactttctatgtttctcagggttaaaatgataatgcagataacaaaatgatgaaattttgtacttggatttaagctggctaaaattattcagttaaacttgaaggtttgtatcattcatcttttgtaaaaaaaaaaaattaacaaatttgcgtgttatgtcatacatatatgcaggtatgtgtttttactaggttgtaaccacattgtttcctttattgtcatagaggattaatatttaaatataattacatctgaatttcttatgtcaaaaacttttaaatattgattatttctaagctatagtaacaggtatagaaagctaaagggataagatattgtatctaacctgtttttagattctgtacctccttagaaatggaacgttcatgatttaaagttccctatattcctgagatgctaccagtagaaaccttcaaggattgctaaaatctgtagtctgtgcactttaatccatctcttattagcttctgcattttgtgatttgactgagagtgacagattgctgaaaacattcttaaatttgcattgggtattaaactaagtaaaaattttgctttagttatgttttatttatgtacctgttagctaaatgttcaaagtctgatagtcaaagctctgcctcttccagttttttcccttttaatttccaatacttttcttaaatcaaaatgacctgttatgaactagttctccattggtatgtctaagagaatgtagacaattcactgtccaagttttttttatacccaaaccttaagaattaagagttctttgaccatactggagacaagaaaagtagatgagcctactgttcataaggtgttatagttgtgtattgctactttatgttttgtttctttgttagtgattgcctcaccatcctatccatgccattctgctattcctcatgctggtgcctctctaccaccaccaccaccaccaccaccaccaccaccaccaccaccacctcctcctcctcctcctcctcctcctcctcctcctcctgctcttgatgtgggagagacttcaaacttacaaccaccaccaccactaccacctccaccttattcctgtgatccaagcggcagtgatttgcctcaaggtaagtagattttgagacttaggtgagggatctgagacttaaaaaatattgttagagcatatctctctttggttgacctattggggaatggggaaccaaatgaaaattgacttgagaacacaatactggaagtgactaaggaaaggagcaattaaaagctgaaaactgagaatatcttctacataatcaacaagtggatggttgagttgacgtgtgctgctgttttgttttgttttgttttgttttggtagctacatgtctaccctgaagaagattctcaaatgaatatctttgcttttcttaactgtttttccttgcaaaacaggacttggtatcaaatttttctttatttcttaaattctttccataagtgcatgaattattgcagtcttttatatttagaatttcaactgaattttaaagatttgggggagtggggattaggagtcttatctgccttgaatttcagctgtgttttcttaaacatctaaggagagtagtttttcattggaagttctttattactcagtttggcatatttctcaagagaattatagttgagaattgtttgtagcttatactttcttgctataatattttcttggtttttctagctgcttctctatttttgcttttttttttccaacccctaatcaccaagattttctttaactcccttctgttttttccctacctttaaacttccctgttacttctgtgtagtttattcctaaatgtagctagccttggcatcagaagttttagtttcttgtctccagatacttgctagacattttcacttagctttttagttttcatttcaataatgaaattcctcatatttatcttttccccagaccacacaaaacattgacttttctccttggttttttattttgttaatagtggtatcatttccacctaattttcccaatatctaaaccctgatttctttactactctcccttcccttacctacctgtacccgagatgtacttagtcaccacataatgctgattttgtatttttccaatattttactatgacaatattcaaacattcatccaagttgaattttaaaatgaagtcatatctatcacttagattctatcattaacatttatactttatcacatatctatccatcttcccctccatccatctctattaatccatcttctttttgatacattaagtaaattgtagacatttgtacacttccccataaaaacttcaggatacatatcattaagtagttttttccttttgatgtgcagtttacatataatgaaatgtacaaaacttaaatgcacattagcttacttttaacatatgcatgcatgcacttgtgtaacccaaatccctatcaaagtataaagtattaacattgtcccacaaatttccctcatgctccttcccagtttttcccgtgctctccctagaggcaaccactgtttggacttttttctaccatagattagttttacctgttttagaattttatagaaatgtaatcatatagtatataatctttatggaaagcttcttaaacttggcataattttgagatttgtctgttgttgcatgtgtcagtagtccatttgttttcatggccgagtagcatttcattgtatgactgttccacagtttgtccattctcctgttggtgatagatagctggactgtttccagtttggggctgttacaaaaaaagctgctaacaaaaaaagctgctatgaacattcttgtagaagtctttgtaaacagatgtttttatttcccttgggcaaatacctagcagtggaattgctgggtcatagagagatatgtgtttacttttataagtaactgccaaacatttttccaaagttgtaccattttacacttccaccagcagcgtatgagaattccagtagtttctcttgctcaccaacgtttattgtcgccacactccttaactttatccattctggtgactgatcatgttgtaaaaaaatctattttatagagcagttttctgtttcttgccaaattgagaggaaggcatagggatttcccattttccaccggcccccacatgtccgtagccttccatattatcagtgtcccccaccataccagagtgtggaatatttgatacaatgatgaacctaccttggcacatcattatcatccagaggccatagtttatattagtgttcattcttgctcttgcactttcatgagtttggaaaaatgaatgatgacatgtatccttaattatagcatcacatggatgctataatggagcatttctaccccagaaatctgtgctctgcctattattattcatcccccaactcctgtcaatcactgattttttactgtctccatagttttgacttttccagaatggcatataggtgcagtcatgcaatatatagccttttcagaatggctcttagcaatatatatttaagtttcctcaccaaatcattatctgaatgtaccacagtttatagatccattcacctactgaataacatcttggttgctcccacttttggttacagttgccctaaacatccatatgcaagtttttttgtggaaatatatatagagagatggagtcttgctctgtcacccaggctggaatgcagtggcgtgatctcagctcattgcaacctctgcctcccgggctcaagcaattctcctgcctaagcctcctgagcagctgggaatataggcacccaccaccacacctggctaatttttgtatttttagtagagatggggtttcaccatgttggccaggctggtcttgaactcctgacctcgtgatccacccacctcggcctcctgaagtgctgggactacaggtgtcagccaccacgccctgtggaaatatatttttaactcctttgggtaaacaccaaggattacaattgctctattgagtaagaatatgttttatttggtaagaaactgtcaaactgtcttccagagtggctataccattttgcattcccaccagcaatgaatgagtgttcctgtagttccacatccatgccagtatttggtattgtcagtgttctggattttggccattctaataggtgtgtaatgatatctcattgttttaatttgcatttcccttatgaaatccgacgtagagcatcttttcatgtgcttatttgccatctatatatctttggtgaaacatctgttaagatgtttggcccatttttaattcaggtagtttacttattgagttctaagagttctttgtatattttgggtaacagtccattatatcaggtatgtcttttgcaagtattttttccaagtctgtggcttgtcttttcattaagtgtctttcacagagcagatgtttttaattttaaagaactctaacatataaattatttcttttatggatcatgcctatggtattgtatctaaaaagtaatcgccagtcttggggtcatctagattttctcctatgttatcgtctaggagttttatgttttgcattttacttttaggtctgtgatccattttgagtgacctttttgtgaagtatgtaaagtgtgtgtagattcatatttttgcatgtggatgtccagttgtttgagtacttttttcatgtgcttattggccatttgcatattttttgtaaagtgttcacatattttgactactttcttttttattgggtgcttgttattgagttgcagacgttctctgcatattctctatgctagtcttttgtcaggtatgtttcgtgaatatctgctcctattctgtggcttatctattttcttcatggtgccttttgatgggtagaggattttaattctgatggaatctaattgatcattttttggtgtgtattgctttctgtaatctaagcaactggccgggcatggtggctggcacctgtaatcctaacactttcggaagccaaggcaggcagatcaattgaggtcaggagttcgagtccagcctggccaacatggtgaaaccctgtctctactaaaaatacaaaaattagctgggagaggtggtgagcacctgtaatgctagttactcgggaggctgaggccggagaatcacttgaacccaggaggtggaggttgtactgagccgagatcatgccacactgcactccagcctgggtgacagagcgaaactctgacttaatttaaaaaaacaaaaaaaacaacaaaaaaccttggccttatttgtcttactccaaagtcgttatgattgtttcctatgttttcctttaaaagcttaattcatttagttttatgtttaagtccactattcatctcaaattcatttttgtggatggtggaggtgatttttttttctttatggatctccagtattccagcagtaccatttgtgaaaaagattttcctttcctcgttggatcactttggtgttttagtcaaaaatcaaatgactgttttaagtgcaggtctatttctgtgccctcttttgttgcattgatcaattttttaatccttacatcagtactatactgtctttttagtaaggtttgaagtaaggtagggtcatttgcatgtctcttacactatcaaattttaccaaaaaaaaaaaaacgtctggaaattagggattgtgtttataatctatggctcaatttggggagaatgccaattcttaacagtatggtctctttgaattcatgaacatagtatcatagtatacccgtcaatttatttaggttgcgtttggtttctcaacttttttttttttggtgtagaagtcttctacatcttctgttaaatgtgtccctatgtatttgggtttttggaactgtagtaaacagaattttaaaacttttattttccaattttgtcctgtacataaaaataaaattgatttttgcatgttacccttggctgatttattaaaaatctgtgtttcacagagtgtttttaaaaaatatccactgcctctttcctaggtcatgcctttatcaccttgtccctgaacagttagagtagcttctccattggtctcactgctctggtactattccactttgtgtctgttcctagctcagaactcttcagtgattctttggtttctgtagattaaagttcaacagactaagtatggcatttatgactttccacaatctagtctctattccaaccttatctctttctactcctatgtgaactctatgtagcaggtttttttctcctaagcctttgctggcgtggtgcttcaactcaaattctttccccattcacttccatctaagttctactaaccccgagaatatatcatgtattcgttagtaggtgctccccattctccctggccttagcaatcgctcctctagtttggccatggatttgcctattctggacatttcatgtaaatagaatcatacaatatgtgggcttttgcaactaactttttttctctaagcatactattttcaaggttcatgttgttgcatgtatcagtactttattcttttttatggccaaaaaaattgcattgtatggatgtattggcatactccattttgttgcactttgctttattgtgttctacagatattgtgatttttattttttttacaaattgaagatttgtgagaaccctgtgtcaagcaaatctattggcaccatttttccaacaacatgttctcccttttctcccttcatttctgtcagcatttttttagcagtattgtattgtattgtttgtttgtttgtttatttacttatttatttatttatttatttatttattttgagatggagagtctctgtcgcccaggctggagtgcagtggtgcaatcttggctcactacaacctctgcctcccgagctcaagcaattctcctgcctcagcctcccaagtagctggcattacaggcacccgccaccatgcccagctaattttttgtatttttagtagagatggagtttctccatgttggccaggctggtctcgaactcctgacctcaagtggttcgcctgccttggcctcccagagtgctgagattacaggcgtgagccactgtgcccggccagcaataacatattttaaaattaaggtatgtacattgttttcttagacctaacactattatactcttaaaagactacagtatagtgtataagcataactttttttttttttttttttttgcaacggagtcttgctctgttgccaggctgaagtgcagtggcgcgagctcagctcacagaaacctccacctcccaggttcaagtgattctcctgcctcagcctcccgggtagctgggattacaggcacgtgccaccacacctggctaatttttgtatttttagtagagacggggtttcaccatgttggccagaatggtctcgatctcctgacctcatgatccatccaccttggcctcccaaagtgctggcattacaggcctgggccaccacgcccggccataagcataacgcccagtacataagcatatttactgggaaaccaaaaaattggtgtgactcacttccttgcaatattggctttatttttttctggaaccaaagccatgatatctccaaagtatgtctgtatcatattttatctattagttgaggaacatttgggttgcttttactttctggctattaatactgctacgtgcgtttgtgtatacaagttatttgatacatacatgtatcaagtagaatcccatgccactcatgaatttatttcctactatttttttaaaatattatgtagcttgagcattaggctttatgctgtgctcctatataatagtcaaaatacaagctgattttaaaaaaaaatggcaataaatgtatttgtatgtgtagggagtctccaacttaaagagggattttctaaaagttcatctgttagtggaactcaggttatattactttataaataaaaatatgtgtggatctcaggtcaaacaataaaaatacatttagaggtccaattggaatgctaagaacagtttttgttcatttatgaaatagtttagtttcataacgtcaagagaaattaccttgctcattgcccttctctttggagttctggtggtggtatgtcagtcatggtaaataaaaacaggatgaattgtttcatattgttctaattgtctcagcaggcatcactaatctctgtcagtgagtattagtctgtactgtatataagtgctagtaactgaggaccaaaatgattgtttatgttctagaagtgtattaaagtaaaaattccatcttgaaacaaacaagaaaatgcctttattggattcttcctaaatattaccaaagtgacattcctgtaacatctgcctacaattaagattagaaataaaaattttatttggtaactaaaccgtagatgagaaaataattttacctatattggtaggtaagtagtcatttactataaggtaaaattgagagtggtattaatgtggcaagattacattgatatcttaataatgctcaaacagaaaagcttttttttttcttttttgagatggagtctcgctctgtcacccaggctggagtgcagtggcatgatctcggctcagtgcaacctccatctcccagattcaagtgattctcctgcctcagcctcctgagtagctgggattacaggcacccgccaccacgtccggctaatttttgtagttttagtagagacagggtttcaccatgttggccaggatggtcttgaactcctgacctcaagttatctgcccatctaggcctcccaaagtgctgggattacaggcatgagccaccgtgcccagccagaaaagcttttaaaagataattctaattgcttatgtcagtcaagtcactaatttttttgatttttaattttagatacaaaagttttgcagtactatttcaatctaggattgcaggtaagtgccatgttaaaatttctttgataagccctattttcaaagtatagaccgttttgataatcagactcttgaacttcgaaagccaaaatcactaaggggactaaacattttaattctgtctaagagatctctgaagatgacatagttcagttgtctgctttagcctcccagtgctttagtttctcttataaaatagtcgttaaactgaagagaggggtactgggctgtaagcagcacaatcagcatatattagatgagccatcatatttaacattacatgctaacttttcactgtggtgttctgtctcaaaataaatgaattatcctaaaatatttttatgactatctttccattttatgtgaaaattagacaaatttgaagaaatttaaggcactgtattttgttctttgaaaccaatgagaacaaagacacaatgtaccagaatctttgagacacagctaaagcagcgtttagagggaaatttatagcactaaatacccacatgagaaactgggaaatatctaaaatcaacaccctaacatcacaattaaaagaactagagaagcaaaagcaaacaaattcaaaacctagcaaaagacaagaaataactaagatcagagcagagctgatagagacacaaaaaacccttcaaaaaatctgaatccaggagctggtttgttttgaaaagattaacaaaatagatagaccattagccaggtgaataaagaagaaaagagagaagaatcaaatagacacaataaaaaatgataccacagaaatacaaactgccatcagagaatactataaacacctctatgcaaataaactagaaaatctagaagaaatggataaattcctggacacacacaccctcccaagactaaaccaggaagaagtcgaattcctgagtagaccaataacaagttctgaaattgaggcagtaattaatagcctaccaaccaaaaaaagtccaggaccagatggattcacagccgaattctaccagaggtacaaagaggagctggtactattccttctgaacgattccaatcaatagaaagagaggaactcctttctaactcattttatgaagccaacatcatcctgataccaaaacctggcagagacacaacaaaaaaagaaaatttcaggccaatatccctgatgaacatcgatgtgaaaatcctcaataaaatactggcaaaccgaatccagcagcacattaaaaagcttatccaccacaatcaagttggcttcatccctgggatgcaagggtggttcaacatatgcaaatcaataaatgtaatccatcacataaacagaaccaatgacaaaaaccacatgattatctcaatagatgcagaaaaggccttctataaaattcagcaccccttcatgctaaaaactctctataaactaggtattgatggaatgtatctcaaattaataagagctatttatgacaaacccacagccaatatcatactgaatgggcaaaagctggaagcattccctttgaaaaccggtacaagacaaggatgtcctctctcaccactcctattcagcatagtataggaagttctggccagggcagtcaggtaagagaaagaaagaaagaaagggtatacgaataggaagacaggaagtcactttgtctttgtttgcagatgacataactgtatattttaaaaaccccattgtctcagcccaaaagctccttaagctgataagcaacttcagcaaagttgaagttgtgtgcaacacaaaatcagtgtgcaaaaatcacaagcatgtctatacaccaataatagccaaaccatgagtgaattcccattcacaattgctacaaagagaataaaatacctaggaatccaacttacaagggatgtgaaggacctcttcaaggagaactacaaatcactgctcaatgatataagagaggacacaaagggaaaaacgttccatgcttatggataggaaaaatcaatatcatgaaaatggccatactgcccaaagtaatttatagattcaatgttattcccatcaagctaccattgacttccttcacagaattagaaaaaactactttaaatttcatatggaaccaaaaaagagtccatatagccaagacaatcccaagcaaaaagaacaaagctggaggcatcgtgctatctgacttcaaactattttacaaggccacagtaaccaaaacagcatggtactggtaccaaaacaggtatatagaccaataggaccaatagaacagaacagaggactcagaaataacaccacacatctacaaccatctgatctttggcaaacctgacaaaaacaaggaatggggaaaggattccctatttaataaatggtgctgggaaaactggctagccatatgcagaaaactgaaactggacccattccttacatcttatacaaaaattaactcaagatggattaaagacttaaatgtaagacctaaaaccataaaaaccctagaagaaaacctaggcattaccattcaggacatagacatgggcaaaaacttcatgactaaaacaccaaaagcaatggcaacaaaagcaaaactaaaattgacaagtgggatctaattaaactaaagagcttctgcacagaaaaagaacctatcagtgtgaacaggcaacctacagaatgggagaaaagttttgcaatctatccatctgacaaagggctaatatccagaatctacaaggaacttaaatttacaagaaataaacaaccccatcaaaaagtgggcaaagaatatgaacagacacttttcaaaagaagacatttatgtggccaacaaacaggaagaactcatcactggtcattagagaaatgcaaatcaaaagcacaatgagataccatctcatgccagttagaatggcaatcattaaaaagtcaggaaacaacagatgctggagaggatgtggagaaataggaacacttttacactgttggttggagtgtaaattagttcaaccattgtggaagacagtgtggtaattcctcaaggatctagaatgaggaatacaatttgatttagcaatcccattactgggtatatacccaaaggattataaatcattttataaagacacatgcacatgtatgtttactgcagcactattcacaatgccaaagacttggaaccaactcacatacccatcaatgatagactgcataaagaaaatgtggcacatacacaccatggaatactatgcagccataaaaaagaatgagttcatgtcctttgtagggacatggatgaagctggcaaccattctcagcaaactatcacaaggacagaaaaccaaacaccgcatgttctcactcataagtgggagttgaacagtgagaacatacgggcacagggaggtgaacatcacacattggggcctgtcgcggggttgggggcaaagggagggagagcattaggacaaatacctaatgtaggtgacagattgatgggtgtagaaaaccaccatggcacatgtatacccatgtaacaaacctgcatgttctgcatgtgtatcccaaaacttgtgtaataaatataaaaataaaaatagctgcatttttaaagcactcatgtgttcatagatgcttgctcaacactgttttttcaccactcccctgagttgtagaggcaggtgggtactgacaaatgtctttatcagtgaaaggtgtctccgagttgaggtgagagctcttttattttagtctttcagggatcactttccctctgaaatacacttgacttaaaatgtaacaagatggcatatttactgaaaggaataatgcatcttaagatctgtcagatgatgataaactctgtgctctcctggataatgctcagattagttcatattccctgacactgatttccctgaagctttagacatgtcagtgccaagaaaactgtcttcccaaatagtacacatctataaattaagagtaatggggtgggtttttgttctttgagactatttttcctaaatttagtttcaagaattgataaaccgcttgccccttctgttatgttagtttattatagtcacatgtggaaactttgtaatctatttcactgaggcatttaaaaatattctgccttttacatcatagaataccaggagatgctgaatagatatttcagtatttttcttattagaaatcatagtgtccattgtagtacattttgaaaatactgtggtataaagaaaactaaaatcacctctatgatcactgtatactttatatattttcttacaattttgtattttacaaactatggattatgctgtataatttttaaatcttttaacaatacaagcattttttctttaaatatttgacagcatgattttcgttgcctgtatagtatttcattacgggtatataatttatccagttccctgttgttaaatactatgtgcaatgttttttgcttttaaaaatactataaaagacacctttgtatacaggtcttttagattatttcctaaaagaattcttaggtttaaatatgagatacaaatgctgcaaaagatcctaaagttctaatagagaacagactgtcaagtttttaggtcaaaaaagtcattgctacctcacctgaaaatcgtggcccaattcttattttttttttttttttgtctgtggggaactgtattacattaagaatagagaagagtgaagtttcttatttttttgttgccctttcttgctcaagtgctattaccacagctactggcactccatggtctatgtgccacagatgcagcagcagcttcatgtagagaattatccagtctatactgagccacctctggtagatcaaaccgttcctcaatgctacagtgaggtgaggagagaagatggcatacaggcggaagcatcagcaaatggtgagtgtgtaatgagattgccagcaagaaagacagttggattttattgtgtgtaattcaataatagctttcatatatttcatcaggtccatgtactacaccagtgattctcaaagcatgatatgtggacctcttgtggtccctaagactctttcaagggattcatgaggtcagaagtgttcacaataatactaagagtttatttgcccctttcactggcttgcattttcattgaggacatagaaaccagtggtgggtaaaactgctgacacctaagcactagttggtactgaccccagactctgctagtaatcagtgtttttctcactgccacacacccatggtacaaaaatgccaatcttatgtttttttgtttaatcaaagacatttttactaaatttttatccttgaatagttgtatttttctttgtgacaaaaatggaactacttataaaacacttctgcatactaaatgaagtataatgattaacttaaggaaaaagacttgtgctattaagttatgagttgtacttgctgacttgaaagagggataagctatcattattcacacttagttgatctggccggcattttcttaaatgaacaaagtgagcctgtcactttaggataaataactagtaatatttgttgccaaagatacaattttagctttcaaataaaaattagaattttggaaaacatgtatcttccaccatgagcttgacaccttcccaccaattaaaactcctgtaataagataagtagagctgaatgtagtttcttaaattgtatgaggaaatgtgtcaacatttggaagatctgcataactcagtgaaggaagagtttcccaattaccaatgcatgatatgaccaaggtgtgatttttgtaacagatctttccaagtgcaagataaaacagtggattttaatgtaacagagcatgaaaaatccacattgctagtgacctttgaggaactaccacttatgtagtttgggtgtagcatcaaagaatatctacaattatctgaaaggctaggtattaaaatacttcactgagccaggtgcggtggttcacgcctataatcccagcactttgggaggctgtggcaggtggatcacctgaggtcaggagttcgtacctgacttgccagggttgttataagaactaattgggaccttatgtataagtatactattacctggtgcatattaggaatactaatttctctcttcctttccatttttaaagcatattacagtgtcaatcttttttttttgaattttgtgcagtataccttttatagagctatttttaattgtagttaactatgaggcagtggcagtcttaatttcacagagttaatctaagcccaagtaatgaattttttttttttttttttgtctaatgtgtatactcattatagcaaggttaaaacagcatttatttctactggaactgactcatggcaaaagtgctatgaaattaaaatgtgatcttaatgacattcaggagatgacacttttagggtgttcttcagagctatactttcaggtatagaccagaatgtctagacacctgagtttttcattgctaaatggttattcggatgatgtatactgtaaaactattggataactcaattgtgaccacctcttacaagaatttaattaactagaaggactctaaagaatatttatgtatttagcttgctgatacctaaatcatcccagaaagatagctgtctgtacattgaatagatttgacacatatatttcacagttttttaatttggaaattttcatattatctttactcattatttgtatttaaagtgctcctgctgcaattgctgtgatctttcttatagttagttttattttcacacataagaacatccatttatgttgcatggggttctgttttggtgaatttttgtatataaagtagactgtatacatcctttctttcagatacttttccgaatgctgattcttcatctgtccctcatggagcagtctattatccagtaatgtcagatccctatgggcagccacctttgccaggttttgactcctgccttccggttgtgccagattattcctgtgttcccccctggcatccagttggtacagcatatggtggttcttctcaaattcatggtgctataaatcctgggccaattggctgtattgctccatctcccccagcttctcattatgtacctcagggtatgtaagatccagcagtatgaagtattcttgcactgccattttcttgctgtttttgtttttaaaaagtattttatgttagtggttaaatgatttaggtgattagtgtttactattgtatttgtctttaaaattattttatcttttgatttaaaatagtactttaaaattaaggggtattattttgggctgtgactaaggaaattgagatggatgtacaactagccccatattgagcatacttcattgtattcagctgttttcctgtcagccatttgtcagctttatattagctgatggtaccaattgataaaatgaatataaagtatttcattggttcaaaaatcacacatcatattaaaccatgcagaattggagtaacttccacttttttctagaaagtaaaaccaagagcctttgcttctggataactcacttaatattaaattaaagagctcttcacgtttcttgagaattatctgaagccagttgcattctgtgatatcagttttgaaggcacatggttctctgctttagatttatcccatatgctattgtttaatactggatgtatgtaagtgttttactgcactgtattgaattggtgtcttttgcacagttagcagtaaataaaaattagcatttaaaattgc

SEQ ID NO: 5845 - DNA, 42645 bp, human
tgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtgccgctgccccttagctggcttctgcccacgcccggcggggcccttctccggctacccggccactcggggttgcctgtttcctcttcccattattccggccgctcctctccctcatttcttcagctccttttccggtctgcccccgcgctctattctccgcctccgcgtcctccgcccctccttccaacggctccgcccctccgagctcgggttttccaccgggctcggcagtttttcctcaggcccccctgtggaccgcacgtcggcgccggcgtctgagccagccgagctcgcctcagagcccggctccttcccctcagcacttggccggagcccgcgcggttcctctcctcagcgcgcgtcgtcccctcagggctcccggttctcgcagttgatcaagtgaggcagaacgggtagtgcctgggttccccccgagtttgcgactccttttccaaagtcttttcctgctgtggctttcgcgggactctgcgagctgggtcgcttagattcatgagtgcttgggaggttcctcgtcgggccccggaccagaaaatagttttgaaaactaagtgaaatcggccacagataggctttttggcggccgtgctccgatgttaacgtcaaactttagtagtggtggtggttcctgctctgttttacatagccagtttaaaaggccctcacattctgatttcctctttcagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcctaagaatctcagggttgggtcttttaattttaattttttttaagttctggggtattctgggggtacatgtgcaggatgtgcgggcttgttacaaaggtaaacgtgtgccatgcatcacctaggtattaagcccagcatccattagctttttatcctgatgctctccctccaataaggaactgacacttgaaccttttcgaggtaaaataaaatcgctagctgaactcactgtagccctttttgaatacacaacttatttgaatatgacaattgagaactttactggagagaacttagtattttggggtgagagaagaatgggaaattaaccactgtagtccacctttacaataaaaaaccctaaacacagaggagcaaaataatttacccggggaagtgtaataaattgtcaacttgacattagtacttgggcttagatctaaaggagtgttctgcctgctgattggttggattggtcatggagaaattggaattgtaagattgtttacatttctgttgaatgtgagtgaaatgaatccagtcaaaaataataacagctacatactgtgtaaattgtttcctcttcagaggaccgccctgatggtctagttaattagacttctagtgcattcagaagaactgcttttggggagcaatgcagttttgactgttgtgaagaaaggtgtttcgttttttcctttcttttttttttttaaagtctagtttgaggagagaaaagtctttagaaatagacattaccaacagattcgtgattaaaaatgtatctcctaggaggtaacagagcctttggcactgctctgaatgctttgtgtatattaactttacttttttaaacaatcctgtgaactaagtactgttagtatctccattttacacatgaggaaactgagacacaagagtggttaagtaatttgtccagccgggaagtggtggacagataacaatctggtgctggagtttatgttctttttttcttttcttttcctttcctttctttctatttttttttttttttttttctgggacggagtttcactctgtcacccaggctggaatgcagtgatgctatctcggctcactgcaacctccacctcccgggttcaagcgattctcctgtctcagcctccccagtagctgagattacaggtgcacactaccacgccccggctaattttttttttctttgtattttagtagagacggggtttcaccgtgttgcccaggctggtctcaaactcctgagctcaggcaatccacctgcctcggcctctcaaagtgctaggattacaggcatgatccactgcacccctccggagttaatgttgttaactaaccaccctagcataagatacccaaaaaggacttatctactcacttatcaatctccttgctctcatttaaaatagttagatgattttacatttcaaaattgaattgatcctaatattctatatttgcatattcatggagatctatccttgactatttctgggatagcacctcacatgtaaacccataagaagtggtcagggtttttcattattgatgcctgtctgtctctattgtaggcttgcttttctacttggggttgaatagaaatgaagtatagtttcacatacagtatgtcaaacctggatcttatttggattcaaggccatgcccaaagcatactccagatggcccatcgtacaatggtttcacttagagtttttcaactttatggtggtgtgaaagcaatacgcatacacattcagtagaaaccgctcttcgagtacccatataaccattctgttttacacttggagtatttaataaatggcatgagatagtcaacactttatcataaaataggttttgtgttagatgattttgcccaaccacaggctaatgtaagtgtgttctgagcatgtttaaggtaggctaggctaagctgtgatgtgtggtgggttaggtgtattaaatgcattttctatttagaatattttcaactgcttttttttttcctttttttttgaggtgagttctcactctgtcacccaagacagggtgcagtggtgcaatcatagctcacttcaagctccaactcttgggctcaagcagtccttccgcctcaggctccccagtagctgggaccacaaccaccatgccttattgtttttgtttttattttgattttttagtagagacaaggtctctctatgttgcagagagtggtcttgaactcctgggctcaagcgatcctcccacctcagcctcccaaagcgttgggattgtaggcataagccactgcacctagcctgttttcaacttatgatggggttataccccgtcacaaggctataccccatcgtaagttgagggtcattggtactagagagcaagtagcatagcactgaatcataggccataatgtcatcatcagtgataaagtaatgtatttttcaaataaagtttctagcactttttattagagagcaactgataactatactcttgtcattttgaatgtataattgaaagacctagtttgtagttctgtcaacttaagttttttaacttttgatttctagctataaagcttcgtggggaccttaacttatttcaaattgtgttgaacaaatttgatttatatttgtaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtatgctagagactgattattattatctcttgccttaattcgtcccttgcacttcctcttatccacctacctaacccatctgtctcttctgcctcttaccttctcccagttaccaaaccttttgattttctcagctgtaaaatcctcccatttgtttgtctcccattttgcaatctctgtgttgtatttctatgtgtatctgtggctgtttctttgcatatgtgaatatctgagagagtgtgtgtatgtgtgtttatttaggcgtgcatgtctccaagacactaattttggagttctaaattttgagttcattatttagattttcattattcaaggaagacaatttgctcattttagttaaaagttttgcctatagtaaatccactaaaatccctaaattatatttactctttcatttattcagttacacccaatatataaaaggcactgttttaggtgctgtggatacagtagtaaacatgagataaagtccctgttcttatggtgcttacattctagtggtggaaaattgataataagttcacaaataaatgatcaaggtatttcatgtggtgaaatgtactatgaagaaagtaagacagggtgatgtggtagctggggtgaagactgattagaattgtcagagaaggcttggcagagtacctaacattttgatctgagacccgaaatacaaggaagagccagtcatgtgaagatttggaggcagaaggaacagcaagtgcaaaagcctaagtaaggaatgaacttggagcttggtgtgtttgaggaacagagggaagattagtgttgcaggagcatagtgagcaagggaatataatagaagatgaagttgggtgggggtagcttatgtaagagttctgattttattcatgtttattgagaagccattgaagtattttaagcagagaaattatggtaaggagtattattttctacaagtatattagaattcaacaggaactgatcatcgtaatagaaggatgaagaaaattacttgtttgttttctattagttcttccttgagacactagaagcttgccaaagggccaggtcagtaattcccacttgtttgactttaaaacctatcctagtttgatgttgcaagaagtaaatgcctcatagaattactatatatgtgtatatatatatttatttacattatagtaaaatgaaattaattttaaaataaaaaacctgagaagaaactggctggagcataatttttcttttagttttactgcttctgtctcttaggcactcagtaaatacttattcattcattaaatatttattgagtaccttctatgtgccaggcattgttctaggcacttggtatacatcagtgaacaaaacaaagactcctgttcttaactgagaggaggcagattcattgattatttcaggagtgaaattgttggtgtccttatcactataatgttggagaagagggaatgtcagggtggctgtgtaacatagaagccagtcttgaactatttagtgagtcaggagagaagctagattaaagaggaataaacttatcttcctaactgctttatgcaagtcaattttttccagatacttttaattagtattttcattctaaatgttaaatcagctttgattttgtgttagtacattaaaaggaaaacactgatttcataaacatatcctgactttttactcatgctgaaaaggaaggaaactgtacaagtctccaatttattttatttttatttttttacagttttaaatgtctttttttctatattaatttcaagaaagtcacataaaagcagtaagcagtgagaaagaatcagtaattgattggttatattttcttttctttttttgagacggagtttcgctcttgttgcccaggctggagtgcaatggtgcgatctcggctcacctcaacctccacctcccaggttcaagcaattctcccgaatagctgggattacaggcatgcaccaccatgcctggcctaattttgtatatttagtagagacggggtttctccatgttggtcaggctgatctcaaactcctgaccttaggtgatccgcctgccttggcctcccaaagtgctgggattacaggcatgagccaccacacccagccaataattggttatattttcattttaggtaaatcatttattttccccagacctaggctggggggtagtatgtttgttctaatttaagcgattggtttaaataaatttccgatgtaatggttctatgtttaaaaccttatttccagcatacatggtggtgtggtatattgtttaattgtatatgaagttatgatagtaaattactggcaaagattatttcacagtcttcatgcatggtctagtagtttccccagcttattatcttgtctggcagctattacttttggtttcaatttttaaattctgttttcatgaatgaattgtgcttcagtttaaatatgcccagtcctgagaagtattacaaagccatgtgaagacatttttcatgaaatatcatttctgaaatatatcagttgacataggagataaggtatctgctgaatttatattgacattttatagtactctttgtattgctttaataatcctagtatgtatacttattaaaatatataaaaattcacatgtgcagtttttagaagtaccactatattcttggaagttagattcagtcatcagtgggcagcagatgaagtatggaattttctcccatgttacctaatatttttcttcttttgttttagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaatatatggttttaaaattgacttaacttgagcaagatacattatgaagttctttctgattagagtgtgtggtctcaagacctttacagtagattatccttaagtgtccatagctctctggtacaatgtttagatatagtttatctatcaaaatagaacattcactataaagacctctcttccattccaatcatattatcccaacatgctaaatgttccaaacattttatttggaatgcattttatcatgtttttataggtttatttttctgattgtgttttatttaggctaatattaaaaaaatgcttactagtggtagaaggtggtgacaaagaaatactctgggtagcaggaggaagccaacttggattaaaattttgctgagaataatctaaaaagtgagtaatctggttgagaattcacagcaccataatcataattgtatatcaatgttatgttttaggaaaggtcctattcaaatccagggagagaatctttagtgttttctgggccctcataaatacgtttttctcatttgagaaaattgtgactttatgttggtcacttagtttttatagtttatgatgaagaattaaagagaaacaaatgaaaggcaaggtctactcaaatatcagacaactaaaaggctatacagcccctaaatcctttgctatctacttccccagaataatgcataacctaaattccattatttcatttagcagaggtttaagccgttgttgtcaattgtgtgcagtaacgcctctgacttcccttttgtggaattttgtatcgattttggatttttaagtcaaaggagactttaaaatcattttgatttggcacggattcttgagattatctagtccaattccatcatattcagattttaccatttgcttaaagtatagcttttggcagaactgcccctaggagcagctccttgattcccagtcccctgctctttctaccctgcataatatatgttgtaagctttttgtttctttatagttgtttgcctagtgttcattttagttactcgaattccttgcaaggtaggttttgtttgtttatttatggaagttatttagtaggaatttcacacttaactgggttttcctttggcgtatgacaaccttacctaggacttagaaatctgtgatttctgagtttttggaatttaggaaaatgctctgggtaggattgatagtagattgaataaattaagactttaagacagaattgtagacttttggagttgggagataatttaaagaatattttaaaccaccagttttacagatgaggaaacatgctaaattaatcaccacatttacatcttattagtccttattaaagaatggtaaccaaaagtctgtttgaaatgtttgctctatttgtttggtttcattacatgacagagctgcaggttcttgatattaatgagtaagtggaatgcagtttatttagcagtgttctattagaggtactgaaattttcagggataaggaaatgaaagagagtttagcattgggaaatttgcaccatggatagattaagaggtagacagttaatagaacatttacgggttggagtagatgaaaagagatgtgatgttttgggatgaccttgggaattaaggattttagatacttataatttgggaggaaagaaagctcaaaggatttgttggtaagatagtataaccaatgaatttgacatagggttctggaacatttaaaagtagtcattatctgcaagtaccatcaagtatctgattttggacaccttagacctctactttttaattttaatttttttttttttgtattttagtagggacggggtttcaccgtgttgcccaggctggtcgtgaactcctgagctcaggcaatccgcccgcctcggcctcccaaagtgctggttttacaggcgtgagccactgcacccggctctactttgtattcttttaaaggcaagtcatatataggcacaaaagagtacaaaaaggttgtttgccactttaatatttagtttgaggaagtttttcaagactaagtaatgactagcagtaatataaatattcttcctggccctttattgtggtataagcacgtaattcctctgatttgttcataaatgtaaaatttgtggagatgaccaaaacacttcatatagtctgagaaatgacacatggacagatcatttgaaattaattttggggaaacatttggaaagggtcatcatgatagccatgtggtgatcaattttctgctgtacatgtaataccatttatttatttatttatttatttattttgagaccaagtctcgctctgtcacccagactggagtgcaatggcgtgatctcggctcagtgcaacctccacctcccagtttcaagtgattctcctgtctctgcctcccgagtagttgggattacaggcatgtgtcaccccgtggggctaatttttgtatttttagtagagactgggtttcaccatgttggccaggctagtctcaaactcctgacctcaggtgatcctcccaccttggcctccaaaagtgctgggattacaggcgtgagccaccacacccggccgtaatacgatatttttattggggagtggggagtgaaaaataattttggttaacactagtgcttagtatgtatcaggtactattcagagcactttacacatatatactcatttaatctttaaatattcctgtgcaataattggtattgtccattctacaaataacataatgtgaaaaaagttgtatttcattttagggtccaagagatgttgtggaaattgtaatttgaacactgaattccagtatacttccatcctttatggggacagtaggagagaatatttgaaatcagaggattttcctaagaaatttagattgtatgttagccacaggcgtaacggtatgctagccataggtgtataacctttttgaatttttacattgctacttaaaaaaccacagtgatggctactcatagaatccatgtgtagaatccatgtggagaaactctttcaattggtttacctgattgcaagttatttacaaatctttttcttttttcttagttgtattttaaagtttcattttggtccttgctttatttcttttcttggaattttcagcattcccacagcttctactgttgactcctttatctgtatctcccaactctgatttgggctcctaaatgatatttccaattgcctttggccctgtctgtctgttaattctgtaagcacctcaaactcaaggtgtgccccaaactgaaatcatatttcttttcattcttctgaggtgcttatctttattaatggtatcatcatttagtcattcttctagcctttaactctgtctccaaccccttatatctaattggtttccaagcactcacagctttatttcctaagtacctcaagcttatgtattcatcattcaggcttttaatataaatgcataatgagaatctaccttttgtatcagcaggatccaagacatgattcctgctctgaaggacctatgtcttactcatttttgagtcctttgcctgaaacacagtaggctttccataaatgatgaatgcacttctgtaacctagtactcttttttgattgtcttgattaggattaggtattgttctaggaaacactgtcatcttgtacacatttatttcatactgactttgatttgacagcgaagtatctagtaagtctcttgttcagaagatgtgaccatcatattgtatggtaagtttgtaggatcaagcacatataagaatagcatcccaaatataacagtgctgattctatgcagtatcttaatggtatttaagggtctgtcaaataatggtacctgtcagggatttgtggcaaaacatgatgttaaaaatcaggtatatgaaaagcactatagtgttttctagtaaaagcttacatagagaaaggtttaggatattaccaaacaattttttttttcctttgagacagggtctctctgtcaccgaggctggagtgcagtggcaagatattggctcctctgcctcccctggtcaagtgaccctcccacctcagcctctggagtagctggaaccacaggcatgggccactacacctggctaattttttgtagagacggggttttgccatgttgcgcaggctggtcttgaactcctgggctcaagtgatctgcctgcctcagcctcccaaagtgctgggattacaggcgtgagccactgtgcccagtcatcaaatgatatttaattacttattaagtggctaatggctaattccctacgtgaatgctctatttattatacagtttttaattcttttttttttttttttttttttggtaggcggctaaacaaaaggtagacaaatctggctaggttcaaacaggaatgtagaatacatgatgctatttattttttttttttttaacggagtctcgctctgttgcccaggctggagtgcagtggcattatctccgctcactgcaacctccgcttcccaggttcaagtgattcaccctcctgagtagctgggattacaggtatccaccactacatctggctaatttttgtatttttagtagagacggggttttgccatgttggccaggctggtcttaaactcctggcctcaagcgatccacccacctcggcctcctaaagtgctgggattacaggcatgaggcactgtgcccggccagaatacatgcttcttaatgttgatactgattcttgaaaaatattttgacaggcttttaataccattatataccatctatgttggtatttctatatcttcattgtcttataaattttttaccatattctggccaaaattacttattttgattgacacttgtatcatagctttgaacatgattttattttggtggctgcagtcctgttctctgaggcagtggttcttaagcttctttcagccatggaactctttaatttaaaactgtggcttttcttctctatatacatgattttgcagtgactttcagaaagtttgcaggacctcatggccccgggttaagaatccctaggctgaggcgaacttcagtaacttcatttcttggtcattgtttattactattttggtcttaattcctagactcatttgtaattaaacccttttgattaattacatttaaatttagtaattcccagtttttatttttatttctatttttatttatttattttttttttgagacaaagtctcgctctgtcgcccaggctggagtgcagtggcgcggtctctgctcactgcaagctccgcctctcgggttcacgccattcttctgcctcagcctccggagtagctgggactacaggcgcccaccaccatgcccagctaattttttttgtatttttggtagagacagggtttcaccatgttagccaggatggtctcgatctcctgacctcgtgatccacccgcctcagcctcccaaagtgctgggattacaggcatgagccaccactcccggccagtaattcccagtttttataatgtaacacaaattcaatactttttttgtttaaagcatactagccaatacatttttgaaactaaccttaatattcttatgctattaactcagtatctgtaacccataatgtcatatagtgtcttttctaatagataataaggactaaatggaattttttatttgtagtaattattttagaatatcctataatagactggtgaagaaatccagtaaggcaatacaatatggtgtttactcatggttaagtgtgctactaaagtacttggttgcaggaccctgatagtcactgttggaatgatgtctatgagacgcatatagtacatctttttgaatgatcatttctccttttgtgcagcattacatactggtcaattctccactgccagtgtgaagtgaggggataatacactccccatatttagtaatgaaaaacattcctaagtccttagcctaaattagtagttttctggatctcagttttcctgtttgtgaattaataaaactaacttctcgggtgatttctaagacataaacctagttgtgtggcatgttttaaaaattaaaaatgctgttgaaataacacattttctcttggttagtttttgttttgagaagtaggactaagatctatttttagaattcacagaatatagtcctaaatgatacggaaagcagatttttcattgaatttcatgtttaaactcatactcagtttctaattggggttatagttagataatttaagtttatttagaagtttaattgaatgagtctttccagtgcttcaaatgttctgggttttttccctccttctgctaatcctgtctctagactgatcagacactgcaggtatcttaagtcaaaaaacaaccttctgctgggcgcgggggctcatgcctgtaatcccagcactttgggaggccaaggcaggtggttcagctgaggtcgggagcttgagaccagcctgaccagcatggagaaaccccgtctctactaaaaatacaaaactagcccggcttggtggcacatgcctgtaatcccagtcgctcaggaggctgaggcaggataattgcttgaacctgggaggcagaggttgcagtgagccaagattgcgccattgcactccagtctgggcaacaagagcgaaactctgtttaaaaaaaaaaaaaaaacaaaccctcagtgtttgtgtgccagtgtggtatattttaaagcaaagtaatattttcctttaaaaaaaaatctgtattgtcatgctatcaggtggaaatggggaagagaagaaaatgaaagcaagtggttcttgataatattttattttgcaattccgaagaaggattacttctttgggaaatccattctttgtcttgcctttatttctccttcctaaaacttgaggaggaggttgaacagggctgccaggccatgctttgttttagaaccattgtgttcccttccttcataaatcttgctttgctaattctgcttgaatgttcaccctgaaaagttgataggctctagttccagggtgctgttaaaatacatttttaaaacacattaccattatattttcagtaatgaaagaccctaaaaagaggttctgtagagttatttcccttaatttgcttcatgttatttggtactaaaaataattgaagtaagttatttagggctaatttttaaaatactggcttttcagtaggttctgttacaagttgttatatgttaatacatgggtttgttatctttaaaaatctaggtctgtttatgtggtaatgtcagatttattcatttttatgtgggccagtcatccccactttttgccaagataataggctaacacccaaaagctatttttaatattgatcacaaatttgaccacttaaaggaaggtgttatcaatattttaatattgattacaaattttaccacctaaagtctgttatccactgttgaatcacagagtaattccctacatttggaagagtgcttagagattatgcagcccatctacttattttacagatgaggaaactgagacttaaagtggtacagccaagttcataacattcttttcatgataccatattgcctctcagaaactaataactcatagcattttgtcatacacatttacaactataccttgtatgtcacaggtaatgtatgctttaaaaaaataattccggacatacctcatttaattggttgaaacgtgaagtgttattttagaattaaaatcattagtatttatatgtcacactacagtttccttgtttatcagtgaagaaataaatatagcaattaaaagggcaaattacgtattctagctaaatttcagtataaaaagtagtcattgcaaaattaaagcccatcagtttcatgacaagtaaactatgttatttaaagttactttaatgttttttcaacttattttaatctgtacccagagatacagtgcttaaaacttaaaatgtcttttttaagacattttctttccattatacttagatgtcaaagggaataattccattagggatggggaaacaggatatggacccatattagaactttgatttccagtagaatttcagtgaaattgctctggttcttacctttttttttttttttttttttggaccaaagaatgattgcttgctgaatgttttgtcaggtagcagctaacagccatccatatttaagcacgaacgtgctaaacactgaatatacagtgtcttttgtattattctaacaaccttaggtttaagtcacaaaaatttctagagcagtgtttctcaaactttgaaacattaataggtgatctatggagggaagaaggtgtttgataaaggctaggtcaaaaatgtgaagcatttactataagcattccttaggacctttaatgttgctaatgggcactgtgaatctcaaggataggattataatatgcaaagtttgctgaaattttggccttgaaattctctttttaggaatatgttgttctagagcagtggttttcaaagtgtattccctggaccagcatcatcatcacctgggaacttgttagaaatgcaaattcttgggattcatcccagacctgcctcagaatcccttgggcaagaggcaatcttttaacaagccctccacttgagaaccactgttctggaagtttttcaggactaaagtagtttgctgtggagaaagccaattgggatttcaagtgcgatatttcaaaggacagtattaaataccttgaagtggctttttattatatgcaagacaaagtctagaatcgacccacagttctctttaaaatatcctattgtactaatctgcagaatggaacctctgctttaccacttctgggcttttgttcatgttttttctgccttggtatgtaattcctctttatggtaattgtgcaaacatcaggagattttatatagttttagtttcagtactgttactgattggatgtgaaaacttaggtaggtcttaaaactatttcagacctgtttcttcatctgtaaagtaagagatcccttggagctgtaaaattccaattacttgttttcccagtttatgatgctattgtttcttgctcactaatgataaaatgtttaaatttgctttctaaaattaaggtaatacatgtgaatagttaaaaatgttaattgattatacaaggcttacaacaagaaacagcagttgtatgtcctattcctccgcatctctgttcctgcttcttatagatgaccgtattactttatgttttataaataatatgcttaaactggttttgttttgttttttaaatttgaatatcattgtaaccttcctacatggaagaggagacttttcaaaaattaatgtttttaatttacacgtcacaattgtatatgcatttatagggtacaatgtaatgttttgctatttgtgtacaatgtggaatgattatgtcaagctaattaacatattcacctcacttacctatcattttttatggtgagaaatttgaaattcttattttgaagtacacaatatattattattgactgtagcgactctgctgtacaaaagatcccagaacttatgtcctctgtctgtctgaagctttgtaccctttgatcaacaactcccattttctcttttcccactcaccccccagcttctggtaaccatcattctaactctctacttctatgagttcaacttatttagattccgcatgtaaatcatgccctctttgtctttctgtgcctggcttatttcacttagcatataacgtcctctaggttcatctatgttgtcacaaatgacagaatttcgtttttctaaacactgaatagcattccattttgtatatgtaccacattttctttatccattcatccactgatggacacttaggttgtttccttatcttgggtactgtgaataattctgtaatgaacacgggagtgcaggtatcccctgacatactgattttatttcctttggatatatacccagaagtagaattactagatcatatggtagttctatttaattttttgaggaacttccatactgttttctataatggctgtactaatttacattcccaccaacaacgtacaacagttttcttttctctgcatccttgccaacacttgttatctttcatcattttaaataaaaaccattctaacagttgtgaggtgataatctcatgttttgatttgcatttctctaatgattagtgatgctgagcattttttcatgtacttgtttgccatttttatgtcgtcttttgagaaatgttcgtttagttcctttgctcatttttaaattgggttgttttcttgcttgttgagttgtttgatttccttacaggttttttttttcgagttatttgatttccttacatatttggatattaaccccttatcagatgtatagtttacagatattttctcaatttctgtgagttgtctcttcactttgttaatagtttcctttgctgtgcagcagctttttagtttggtgccataccatttgtctatttttgcttttgttacctgtgcttacagggtcatattcaaagaatcattgcccaaagaagtgtggagcttttcccctatgttttcttctagtagttttgcagtttcaggttttatatttaagttttcaatccattttgagttgattttttaatatgatgtaaggtaaggatccaacttcattcttctgcccgtggatagtcagttttcccaaccccatttattgacaagactgtcttttccccattgtgcattcttaatacctttgttgaaaattgaccataaatgtttaggtttctttctgggctttctatcctgttcctttttttgatgtgtctgtttttataccagcatgatgctgttttgattatgctcactttatatatgatttgaagttagggagtgagatgctgccagctttgttctttttactgaagattattttgtctatttgggatcttccgtggttctatataaatttaaggatttttttttttctatttcggcaaaaatgtcattggaattttgatagagattgcattgaatctgtggatcactttggtagtgtggacattttcacaatattcttccaatccataaacatgggatattgttccgtttatttgtgggttttttttttttttttcagtttttttcatgagtgttttatagttttcagtgttatatcagtcttttacctcattggttacatttatacctaagtatttgttgctattgctattgtaaatgggattgttgtcttaattttctctttggataatgtagaaacactactgattttttatatgttgattttgtatccttcaactttactcatttttttaatcagttctaaccattttttggtgtagtttttaggtttttctatatgtaagagcatgttatcagcaaataaagataatttcatttcttccttttctagtaggatgtgttttctttctcttgcctaattgctctggctacgatttgtatgttgaatagaagtggtgagagggggcatccttgtcttgtccctgatctcagaggaaaagctttcgatttttcactcttgaaaatggtcatagctatgggtttatcatatgtggtgtttattgtactgatatacatttcctgtatacctaatctgttgagaggtgtttttttttgtttttttttgtttttttttgagatggagtctcaccctgtcatccaggctggagtgcaatggcgtgatctcggctcactgcaatctccgcctcccaggttcaaacgattcacctgcctcagcctgctgagtagctgggattacaggcgcccgccaccatgcccagctaatttttgtatttttttttttttttttttttagtagagatgcggtttcactatgttggccaggctggtattgaactcctgacctcgtgatctgcccgccttggcctcccaaagtgctgggattacaggtgtgagccaccgtgcccggccaagagtgtttttgtttgtttgttttttcattatgaaggggtgttgaatcttgtcagatgctttctctgcatctatttaaatgatcatgatttttattcattctgttaatgtggtgtatcacatttgttgatttgtgtatattgaaccttccttgcagccccaggataaatcccacttgagcatggggaatgagtcttgtaatgtgttgtggaatatagcttgctagggttttgttgacgacttgcatttatgttcatcagggatattggtctgtaaatttctatttttgtagtgtccttgtctggctttggtatcagggtaatgctggtcttgtaaaatgagtttagaaatattccttctttttcagttttttgaaagagcttaagaaggattggtactggttctttaaatgtttggtagaattcagcagtgaagccatggggtcttggactttggtgggagacttttattattgattcaatctccttcctcattattggtctgttcagattttctatttcttcatgatttagtcttggtaggttgtatgtgtctaggaactcatccatttcttctagactatccaatttgttggcgtataattgtttatagtagtttcttgtgatcctttgtatttctgtgataacagttgtaatgtctcctattccatttctgatttgagtctttttctcctagtctagctaagggtaggtcaattttgtttatcttttcaaggaactaactcttagtttcgtttattatttttctatcatttttctagtctctttcatttatttatgctctgatctttgtttccttccttctgctaactttaggttgttctttttctagttccttgaagtatgttagattatttgagatctttcttcctttttagtgtaggcatttaccactataaatttccctcttagaactgtttttgttacatcctgtaagtttttgtatgttgtgtttccattttcatttgtctcaagggttttttttaatttcctttttgatttattctgtgacacattgacttgttcagaagcattttgtctaattcccacatatttgtgtgtttttcaagattctttctgttactgatttatagtttcatgccattgtgatctgaaaagatgcttgatatgatttcaatttccttaaatttgttaagacttgttttttagcctaacaatgtgatctatcctggagaatggtccatgtgtgcatagcaagaatgtgtattctgttgctgttggattgaatattctgtatatgtctgttaggtccatttggtgtaaagtataattcaagtctaatgtttcctaattgattttctgtctaggttatctgtccattgttgaaagaggggtaatgagatcccaaagaggagactttttcttttttctcttccccattttccttcctatcctcctaatttagttttatcagttctgtgagattcattttcaatgttgacattattatgactgcttaactacggtattattcacatctgagccatgtagtgttcaatgattttatttcctttcctgtaaaactttgttttatctcattttgttatttcatcattttcccactttttgatagtaacatctccaaactttccaacagaagtgtacatctctcattatattcaaacacatcgggttatctaaacctttattatcttttttgagatatccacactggagttctctgtcctatttttggaaatgcttattttctagtccttctgagtgtctatcttcctgcgatttccccttcatccttatcctgtaatttctctttgcttttctcttgtgttgaatctcctatttccaagattgctcccttccacccccagactttaaaaaaaaaattctttattttggtttcacatatcttcagtagcttttctgagaaagggtggcaacatttttgaatctttttttttttctaaaaacaccttgttttactctttcatttgatagcttgcaatagaaataaaggttggaaataacttcccctctaatctagagcttcattgttttccgaatcctagtttttcttttgagaagtatattgtgttcttatttgtgttcttttgtgtataaactgttcttcttctgtgaaagctttaggatcttctctttatcccctgacttcagaaactttattgttatgtccagggatgatcttttttgctttcattgttgtggctgcttcatgggccctttcagtctcaatatggatactcatgttctacagtgctagaatttttttatattgtcatcatcatcatcatcatcatcatcatcattatcatttctttccctctgctttcctcatttcacttcgggcttcctgttggttagatgttggctttcctagattaataatctaattttcttattttttcttcccaatattgttgactattctgtgagctcctcaactctgttatttcttctgcttttttgttttacttaactgttaaatttaaatacagtaaaattggcctgttttcttatatagttctataattttgacaaacgcgtaatcatgtaaccactaccacagtcgagatgcagaacagttccagtgcccccatttatcctttctctttgtagtcagcccttcaaccctaactactggcaaaaactaatctgttttcctttcctatagtttggcctttttcaatgtcatataaatgcaggcatacagtgtgtagccttttgactcatgtctttttttgcttcgcatgttacatttgagatacgtgttcttttatgtatcaatatttcattattttctattcctaggaagtattctattgtttgaatgtaccacagtttttgtccattcaccagctgaaaaatgtttagattgtttccagttttgagagctcatgattatggataaagctactataaacattcacatagaggttttggtgttaccatttctcttatgtagttacctagaagtgggattgcttgatcatatggtaattctgttcaattttataagaaactgttaaactattttccacagtggttgtactattttacattcccactagcaacgtatgagagttccagttctatatccttttcaacacttggtattgtcagttaaaaaaattattttagttagtatgcagtagtatctcattaaagacacacaaatggccaataagcagatgaaaagatgctcaatatcattagccactggggaaatgcaaatcaaaaccacagtgagataccacttcacacccaccaggtttactataatcaaaagatggaaaataacaagtgttgataagaatctagagaaaatggaaccctcatacactattggtaagaatgtaaaatggtgcagttgctctgaaaaacagttcctaacattaggttaaatagagttaccatatgatccagtaactccactcctaggtatatacctaagataattgaaaacataagtctaaacaaaaacttgcatgtgaatatttatggaaatattattcataatagcccaaaagtggaaacaacccaaatttctatcaactaatgaatggataaacaaattttggtttatgcaggggattgaactatgtagtgatgcaccatgctccaacatgggtggactttgaaaaccttatgctaagtaaaagaagcgagtgacacaagaccacatactttatgatcccatttgtttgaaatgttcagaatatggaaatctatagattcaggaagtagattagtggttgtctggggttggtggggatagagggattagaggttgacagctacaggatgcagagttttattttgggataaagagaatgttctaaagttgattatggtgatggatgcacaactctatacaacaaaccattgaattgtatactttaagtgggtgaattatatggtatgtgacatatctgaaagctgttaaatttaccagttttaagagtacaatttaatttttagtgaatatacagaattgtgcacatatcaccacaaaatagttttagaagatttttattattccagaaagattctttgtgcttatttgtagtcaatgcctatttccactccagccccgggcaaccacttcatctgctttctgtctctagatttacccttttggcatatttcatataaatggaatcatattccttttgaaatcatacagtttttgcttccatcttcttaggaccagtttctccaatccttgttaatgcttgttactgtctgtattgtttattacagctatcctggtaggtatgtaatgatgtcttattgtggttctaattttcattttcctaaagatcaatgattttgaatatctttttatgtgctcattagtcattcttatatctttggtgaaatgtgtattcaaatcttttgtctatttaagaaattggattttttttattgttgacttttcagagttctttatatattttggtacaaagtttttctggttagatatgtgatgtaaaaatattttattccagtctatggcttgtattttcattctcctaacaatgtcatttgcagagcaaaagtttttaattttgataaaatcgagttaatttttttttctattatgtatctgagaactcactgcctaacccaggatcttaaagattttctcctatgttttattttttaaaattttgaagttttattttacatttataccactttgagttaattatagtacaaggtgtgaggtataggttgaggatccttttttttgcatgtggatggtcaattgttctggcaccacttgatgaaaatgctatcttttttctattcaactgattttgcacctttgtcaaaaatcaatggaccatatttgtgtggatctacttctgtgtgcttccctgtgtgttaacttttctcttgctctgtctccttttgtcttcctgtccctacttgtgtttttttttcagttttctattacttttctgattctctccctccttctcctgattttcccttcccccattcccttcctcaaaatgaagcatttagattgcattgttttatatatcatacttatttttagtttaaaaagcagatgtgaagcatttgtgtttttctttacaagtacaatatgctggaaacaaattaacttttaaattataatccctttttttttttttgagacggagtctcgctctgttgcccaggctggagtgcagtggtgtgatctcggctcatgccattctcctgcctcagcctcccaagtagctgggactacaggcgcccaccaccacgcccagctaattttttgtatttttagtagagatggggtttcaccgtgttaggcaggatagtctcgatctcctgacctcgtgatctgcctgccttggcctcccaaagggctgggatcacaggcgtgagccattgtgcctgaccaaattataacccttaattaatttttctcagtgaattagtgaccttaacgaaagatggcaatctctcttcccaaactgtgtgtttcagaacttctgcaaaaggcatcacttctccagtgttacagtttctttaaaaaagaaattagtggctggacatggtggctcatgcctctaattccagcacattgtgaagctgaggtgggaggatagctttaacccaggagttcgagaccagctgggcaatgtggcaagaccccatctctacagaaaatagaaaaattagctgggtgtggtggtggcatgcacctgtggtcttagctacttgggaggctgaggcaggaggattgtttgagcccaggaggttgaggctgcagtcagctgtgttcacaccactgcacttgcacttcagcctgggtgacagagtgagacactttaaaaaaataaaaagaaattaaggtaatttcaaattggcatgcaaaggaagtcaagatttattccttttttaccatgtcaaacattatttcattcccaaattataaaatattgctgcttttcctagagggagcagtcatgattactactggatccacagatacaaaaaaaaaaaaaaaaggaaaaaacaattttgaaagcagcttaatgttgtgccttctctaaagccagcttttgacctatttatttttaatacttaaaaaatgtaagaaaggaattggatttttgcatttaaataaaaataaaagacactagatagtatagataataggaacaaataaaacaagcaattgggcctgcctttggcacttagtattttctttggttttctcagaatccagagtaatgtgtctggaaaagtacactagtaaaacattgaaacacatctctcattgtccaactcatctcatactctaccataccatttcaaatgtagtctatccatttgtggatattttcatgctgcttccatttaaatttttatttccatttttaaagaaacacacttttttgcatttttcttttttattggtgccatatagtagtttggaggcattagtcaagaattgtataaagtttccctagcatggctaataagatttagtttctgtgatcctggcagagattattatctagaattaaatgagaagattacttcaaccctatatctgaaatatccaggtaatagccttggcacttagcttgaactgtgccctctgccgctatagattaagggaagttccttctccttttttgtgtttattaaaaaggtattaatgcaaatgcttactggttaactaggttcatgaagattctgtccctccatgtttccctgaaactatgaaaggagcagggaatttggggagagactgtagttgaaaattcagctagagatcttaaagcaattcttcaagcaatgtaatgtggaccaggctgcatcctacacacctgagccttattgtagtcccttttcagcctcgtgcagcagttgccccgagttaagctgcaaagtcagtttccttctagacccaaagctcagctgcttatgcatacttttctcaaccttggtctgattgggttagattgggttaattccactctttcccaaggaggtaactctaagtactttctccctccctcccatgtctcctgcttagtctgagttccctattcctaggaggattggctcttcctcttcttttcacagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcaggtaaaaggaaaacatatcttccctgtactgagttttcagagtttgagacatgggatggtcctgtagtttgccagaagaaacaaaaaaattcccctgctttctagtgaaaacatcgggcctgtcaaggtcctagagagaagctgcctgctcttattagcttggtgcatgcctttgctgaatagtctatattgctgaacctttgctatcttttctgtttttttaaatgccagtttgtaatgtaggaggggtaagataaggaggctaaagacaactttgaaatatatcttgatcctttgtaagcatcccctgcttcctctaattttaatgcctaagaaaaaaattataggctgtgcacataaggagtagaaaaggggatggggcatgacagtcatccttcccccatttcgttgaagatgatattaaaaaaacttttagtaagatgatttaatttcccaatttcctacatatgttctgaataaggaagccttaagtgtccagttcatagtcttgatttagaagtgcctattttaaatgactactgacagtgggctggtctttctcttctttttagttgttttgcagccaggtccatcatttggaaatcaggaaggcttgtgtctcatatatgagggaaaatcaacaaacttttgagtctgtaagtagaatacatacccaggggagaactggtagagtgtgtagcaggtggaaaaataattgtgagcacctaccaaaattaaactatatcatgctgtctcctcaatagcaaatatataattcccaactggctcccttcccagtagctaacatgcttcttgagcctctgctagaattaggttgtttaggactctaattaaaaatcaagaataatctacattttcccactacttacctcgtcctacgccaagaactccagaccctaaaaagttatgttttgattgctgttttatattatccatacagttttattgaacaattaataatagttcatgaaaggtttggctctgttaatattttgcaatgcatattttaaaatacgtaaaaatgggaaccccctctattttcttgcttaatcctgtgtacaataatcttcagccagtcaatttgaggaatcttgtaaaacttaattgtaagggaacaaatgagtctaagtatctagtctttccatgtcacaaattgtataattagagctctgccactaatgattaactttaggtaaaacaacttacagaagacatatttgtacaccttcatgtatttgaattcttgttaatgaaattggaggcttccttttcttttttttttttttaaacacttctggcccttgcagtgctatttgtttcttctgtttattgtgggtattcgcctgctgttcgagttttactcctaattttctcaactggtttcagtgaattttaaaactatgtgaagacttcttgacttaaaagcttgttaccttgaagttcattgtagtcttctctacacctggggaaaggattattagtaacattacttcaaatgcaaggccatagtgtaaagcagtgcgtctcaagtatttctgtgcatacaaatcacctggagatcttgttaaaatacaggttttcattcagtaggtctgagttggggcccgagatttctttttttttttttcttaccttgagacagggtcttctctgttgcccaggctggagtgcagtggcaggatcacggctcgctgcagcctctgcctacgaggctgaagcaatcctcccacctcagcctccaaagtaacttgggactacaggcacacgccacctcactgggctaagttttttgtgtttttagtagagatggggtttcgccatgttgcccagactggtctcagactcctgggctcaagtgatctgcccgccttggcctcccaaagtgctgggactacaagtgtgagccactgcgtgcagtggagatttctgcatttttaacgaactgaagtaatgcttgctattggtttgtggacaacattttgagtaacaaagatgtgtgtaaaattttaaaactacgtaaatgaatctcaattcagtactgagtgatagaaaccagaccccatgcaaagtttatactgtttgatttcccttatataaaactctagaaaaaatacaagccaatctgtagtgacagaaagcagatcagtggttatatgtcagttatagaggggcacaagggtacttacggaagtgatacattcaccatctcaattgtgatgatgatttcatgggtgtatacataagtcaaaatttgtactatttaaattgtgcagtttattgtatgtcatttatttattttttgagatggagtcttgctctttcacccaggctggagtgcagtggcacgatctcggctcactgtaagctccgcctcctgggttcatgccattctcctgcctcagcctcccaagtagctgggactacaggtgcccgccaccatgtctggctaatttttttgtatttttagtagagatggggtttcaccatgttcgccaggatggtctcgatctcctgacctcatgatctgcctgcctcggcctcccaaagtgctgggattacaggcgtgagccacaacacccagcctgtatgtcatttatatctcaaaactttttaaaaggaaaatttaaatgattttttaaaagtctagtgatatgtatccatggaactagaaataaatctattacagtccctgagtttaatttcatttttattgaggcatattttacattcaataaaactcgtcattttaagtttaccatttttagttttggagatgatatgcaatcatggaactaccactgcagtcaagatatagaatgtttccgtcacccctaaaaggttcgcttgtcccatggtctttttagaaactaatgaaattctctttaaagttcctcagtttaattttgtaaatgcatgttttgtcaaatttgaaatccttagaaatactggtcttgcttgatttatgaaaattgtcattacttaaattggcatttcaaatgaaactcgaaagcataccatttgatgaaatgcactggtatgtggatatgccaggaccaattcctaagatacttttatactccagcttttctccactcatgacttttgtgtatgtgcaaatcttcttgaggtgctgtgcaaagtagatacttacaccataattgttgagctgagcaaaaaacgcattgcaggataatgtagaatataatcagatttcagtaatgctgtgtatttggttaagttgagtttgttttatttttgaagtatgtggagggatcttttgagaaatacctggaacggttgggagatcccaaggtaagatcaaatatgggggtttaatcttttcagagttatttggaatagtaatgtaaatttattcattcaactgtattattttagccagaccccaaatattttatttagtagccagctgtgttgaatccaatagttctcacataagtttagaggctggcaattgaccaattgttttgtgttgaatattgataattgtgtgttaatcccatcaaccatagactagcaaaagagtatacactacttggaaacaggacaagcttaagccttttcactttaacgggggaggagggtggtaatgaattttaccaagaggtcattattttgttattaaacaattcccctgatttgtagttgtcttcctcttatgtgggagtaaaattcataaattcatgctttatttagaaataatttttatgtgataaagttaattccatagttctggacttaaaaaagcacatttactaaatccctactgcctttttattatactagttccatttttattgtgtttttaaaatctctcctattaactgtccttattacttaatggctaagtagggctttagatccttctttcaggataagtttatgttaataagtagctatcacagtattccaagccttaaaacaggttatagtgtgttctacaaattcttcatctaaaacagtgctaagcagctaaaaatttgttgtgcttgaaaaaactacctcctagctacagaatgttttttaaaactcaatacactatttatgtttaggaaagtgctggccagctggaaataagagctctttctctaatttataagtaagttatatcctcttttctttgagagtgggtatgtgcatgcatgtgtgtataagatctcaacggtctcttcaggattggggaaatttgagatttgatgtattgatacctagaatgaagaaagctaagaaaaagtgttaaaatattttaaatggttgaaaagtcaaaagaagaatgtttcatgggatggaaaaattatataaaattcagatttcagtgtctgtaaagctttgttggaacacagttatgctcattcacttacgcattgtctgtggctgctttcatgctaccaaagcaaagttgaataaaccatatagtctgcaaaagctgaaatgcctattttctagccttttgccaaaaaaattgccaacctctgctttaaataaaggagagcaccatcccccaactcacagacatacatacaattgataattggttgtctttaccccttctcctcccaaattaagatacataaaaaaaaatccataggactttaggggcaattagctgtctaccttgaattaacatcatttagcccttttgggttattttaaagccaaacattaaaccggatatttatattactttatatgaataaggtaggcaacttaaaagcacaaatagttgttcctataactatctcttacgtatgccaaattatgtcttcccacttacctttgttttccccatatagtcgggatttcattctttatcgctttcctggaaaacctccaacttatgtcacagataatggctatgaagacaaggtaagaagatgagtgaatgttgacttatataaaagaagttgaatgatgcttctggcttgcctggatattaaatcatttttaacctaattaatgaaaagcatagtctgaatgacaggtttctctgttactagcattttcctctctagtcagttaatctcagtgttgttagccctctaaacagacctgatcgtcatttctctgtgataggaaaaaagccaccccaaaccctaattggcttctcaatgactaaaaaggataaggttcaaactttgaagctaggcattcagcatcctgaaaggtcccaaaccagcttcattttcttccatccttattatgccatgcttccaggtattctgcttttcatactttgtgtctttgtatttgaaactttcccaatgcccctggagtcattttctcactttgtgctcccttagcagctcccaagtaattgtagtgtttattatattgtgtttgttttcatatgtatttctttcattatctgaaagtttcttgagggaagtgacagtgtctactactgcctggtaaagtacttgattgttagttgagaatactcagcagataaattgtttgtcagcatacagcttctccaaaaagtttataaaagaaaagccctttatcctgattattttattagtgaaatatagactacacaatgtttgagttctatatgtcttatttcacaacatggaacacaatttagacacaattctaatgatggcatgacaagactggagaccaggagaactgttaggatgctgttacgataatcgagggtgaatacctgaactaaggagaagtagcattaggaatagagaagactgaataggagataacttagaagataagtatgaacggggtacgttaattatctcttttctgagctttggggacaccaaaatgaatacagtgaaatccttgccctccaagagcttaagggacaatgaagacagacctgcaaagggttaattacagcaaagtggtaagttttataataaaaaaaattgtgctaaaagcataagggaaaaagcccttctttctgcttgagggagtttagaaagcttcatggtggtagtgacatttaagtggagtataaaagagtccatcaaatatgaagagcagtctattcagaggaaacactatatacagaggcatagaagcaagagaccctttgggagttaagtagttggatgtgaggaggatgatgctggaaagatagtctagagttacatagtaagaggtagagcaggccatgccaaataatttgtcttttcattgtacagaatagtcatttgaaactttttcccaacgttttattatgatgttcaaacatacagaaaagttaaaagaattttacagtgagcatccatatacctacccaccacctagagtctgctgttaacatcttagtattcttatcacatatctattcctcgatccattcatctgtccatctttcttttttgatatattttaaagtaaatttcagacaccagaaaacttgaccctaaatgctaatggaaagtttttaggcaaaggtgtgacataatctgaattgtttgaggaagaggagtgttaacttttgtatctaagcagttgtacatagcattgcttgagatgaaatttggatctttaccagggatctttaaactcccagttcagtttttcctcaacattgtattctgaaatttttcatacagagagaagtatgaagactcatgcagtaaacattcatgtacccaccacttagttcctacaattacacagttccatttataaatgtcttgtgtatcttacagagagattatttagctaatttagggggaacgttacccattgggaaccatgagaatacaaaaatttcagaccttttgagtgtgtacaacctacaaatatccatacatgtatacagagctaatacttaccagcacttgggtattttcatgtacaggatagtgcatatatatgtctgatttgggaatttatgaagtgggagtgtgtgtttatattgaaaagccaggtgcttttattttgtgatgctttgctttgcctaaaactttgttgctttatctcagttcacactcctaagattggcatcaggattgaatttttaaaaatgaggccgggtgtggtggctaatgcctgtaatcccagcactttgggaggtcgaggtgggtggatcacttgaggtcaggagtttgagaccagcccggccaatatggtgaaaccccgtgtctattaaaaatacccaaattagctgggtgtggtggcgcatgcctgtaatcccagctacttgggaggctgaggcagaagaatcacttgagcccaggaggcggaggttgcagtgagccaagattgcgccgctgcactccagcctgggcgacagagcaagactccatctcagaaataaataaataaaaatgattgtattataggcagtgaacattattaatgagccttctaaaaatattttagaacaaactttcatagaaataaatgtctaatattcactttggcatctttcatcttgtgtgttgacttaattctgcattctacatagttatcttcagtttcttaagtgtattcagctgaaatcgagccatcttcactcagctcatttgctctatctagatagaagtacatacttacattaaaaagaaaataaaattaagtcttgaaatgtagagtaagaaagtccccactcatcctcttcaattttatgcccttcaaagtaacaagtattggttctcatgcacttcaaagtaacaaactattaagtattggtgagtatctttctgtatcattttatttgtgtttgtcttttaaatgtaaatgggcccatatttaacattgttacttgttctttttaaatatccttcttagtaatatagatctaccccattttttcactagtttactgccattaattacatcccatctgcccactcccaaccacccacaagtatgtatgaattactttcatgttgggaaagccatcatgccttgttttgcctcttccagtcaaaatggaaattcttgccacttgaatagagaaattatatagttgtctgtcttctttctataagaactgcttattcatcactctggttaactggattcctttattccttaacaactgcctctaagttattaatatttcttagagttcccagttcttgtagcccaaagtacaaaggatttctctgctcaaaatctgctcactgttcttatgggttaataaactcttaaatgcaaataccccttgtggtgggagaaacttataacttaaactttactgtgagttacttaagcttgacacttgacttcagtactttgaaatggattattactgaaatagaattgtgatttccaaaaagacaagtgaagaataatagacctgggatcaaataactggattattgggagaagttagcccagggaagagtaggaagacagaaaaaaagaatgcttaggataatttttttttctgccaaggaggcttggtggcaacatctttccacagattgcagaatcattttgagtaactcaggttgctgataccttcaaaatggaagaaccttaatcactagggattatatcccttatataagacatttttttttgttttttttttaagagatggggatctcactatgttgcctaggctggagtgtggtggctattcacaggtgagatcatagcacactatagcttcaaacccctgggctcaagtgaccctcctgctgtagtagctgagactataggcacacaccatcccacctggtgaagacagattttttcaacaaaaattcagaaaggttttggaacagttatataaacaaatttcatcacatgcaacattttgactgaaaaaattttgcttaacaagcatggcctttgaattgttttgggaaaaaaaaacctctagggattcagggaatcagctcagacgttaaactgtcatttttgtagcctgagatgtgccttaattcattgaggaagtctctctagcagtattggtgctatatagtgtattgatatattgctattcagttaaatggataactttcgaaataattgaataaaatccctttcctcccttagtctgagtttggagtatttgggtatttgacctaatttttccagtcattcttggaagttagctgggtcttttggcatctgttaggctttctgttatgttcaataactcaatttctaagtgttcctttttttttttttttttttagcaaatttgtaaatcaggacttgtttggtatattaatgtgattgaggctcacagtgtaaccttagtagtgattttaatcttggcatttaaaagtcactgccaagaaaatctctatgaggtacaggttgcatttccttatatttagattttaaaaatcactttaaaaaaattcagttagttatcagttactgactactgactcaatttcaagttaattatcatcttaatttcatggttttaagatgtgtaacattcacttaattgttctgtgtgtttttctttagattctactctgctactcaagtagtggtcactatgattctgtgtactcaaaacaatttcagtcaagtgcagctgtttgtcagggtatgtgaaggctttataaattgtgggtgtgatttcagatgacttgttttcactcagggacccaccatgaatagcccctttaaaaccttgttggtacctatttgcacgcaggattatgactattttcacatagttaatataaatcttattttgacaattggaattttgaccattttttcttcagctgtattgtacgaaattctctataaagatgtgtttgttgtggatgaagaagagttgaagactgcgattaaattgtttcgaagtggttctaagaagaacagaaataatgctgtaactggaagcgaggatgcccatactgattacaagagttcaaatcagaataggtaataaagggaaaggggatatcatgataattatgtttcatacttctgtgcataatcatttgaaagtggaaggggcctggcaagcttatgagttaggttacatattcacacgtacacatatgttaggatatatatttttaatggggggagagttttaccaaagagatgtgtcgtgagatgcccagacttgggggttttgttcaggtccgttttgtattgctagaagaaacttcagaactatctaattacatgattctcaaactttagttgtataagaattatagtgcttgttagaaaggcaggttcctgggcctactgtcacaaaatttgaggtcaggatgggaccaggaatctgttttttaaacaagtgtgcctaagcattctgatgtaggtaggctgtggatcatactttgagaaaatactgattctaaagtagcaccatcattttctaggtaataactgaggttagttgacacatccagccagtagaaaatttctcagtgtaagttttgggagtgttttagtgtctgcctttggtatgcactgtgagtgtgcctctgaggaaacaactgttgaacagctctagttgaacactttgggtttgaaataataaagtacatgtcttatatttcttcctaattcctagttctgcctgcaaattcagataggtttggtgctaggtaagtgtcaccttgtgttttttgtcttgcagttctatttcttggatgtttaaagcttacaattttttttctttttttttttttttttttgagacggagtctcgctctgtcagccaggctggagtgcagtagcgcgatctcagctcactgcaacctccgcctcccaggttcaagcagttctcctgcctcagcctcccgagtagctgggactacaggcgtgtgtcaccaagcccggctaattttttgtatttttagtagagatggggttcacaggtttagccaggatgatcttggtctcctgacctcgtgatccatccgcctcggcctcccaaagtgctgggattacagacgtgagccaccacacccggcagaagagggtttttaaagcttatttgggactgccaggagtggcaaccatgtattagggtaaaggttgcttcactcttcactgatcacttgtcttaaggacttcaggcttacggaaactacagtagtcggaaagcaaggtgtattagttatgttttgctgtgtagcaatgttactacaaacttgccagcttaaaacagcacatttttctcacaatttatgtggattaggaatctggacacggcttagctagatcttctgctgagtgtctcataagactgtaatgaggatgttggtcaggactgagttcttatctggagctttgactggagaaaagtctacttccccactcatggttcttggcagcattcagttccttcgagctataggactgagagcttcaagtttttgctgtcagttggcagaagtaaccctcagctctgctacattgcagtggtgaatatggctgtttgcttccttataggcagcagaggagagagagagaccagtaaaatgaatgaggcagggatcatagggatcaccctaagagtgtgttctcacaggagttgtaaaatataggaggtaatctgctaagtatattgtagcacatacttataaaaacgaagcataaatgcaaatgttggaatgaaaaagcatttgccttatttttagaactgagttaatttaccactaggtggtggtgtagtcattaggcttaacataagtaaattcttcatttataaaaagctctttgctctaaatcttttgaattaggatggaagagtggggtgcctgctacaatgctgaaaatataccagagggctacaataaaggaacagaagaaacaaaggtttgatattttctaaggcaaagaattttcatagtcttggcttgcagcatcatgacttaaactagttaaagtcagatattatattctagttatatgggttgagggaggagttggtcattttcctttgtgaaagtcttacctatctttaaacttcaaatgcatacttaatgttctttgaattcttatttttacagaattttagatttttcagaacaaactgaacacttcagaaatttcaagagcaatatgtttttaagttaaatattacaaacccaatatttagtttgtaatcagtcttctgacgctaaggtttttttcattaaggaatacaatgcctatctttattttattcaaactaggtgataatcatggtttaaagttagagaaacagaaatttcaccatccgtataggactaaaatcaaataggccttcagtttgaggctagctaaataagtcaaatactattatagcaatctctgtgtatacctgaggtgcttataattttggaatagtattgaatatggtgaaattctaggaaagcagaagaaaaatggtagttcctttggaaattttaacaggatttgaccataatgaagtaaccttcagatatttccaggtgattgtagagtacagaaatattgcacctccatgtgtatatcatgataacacttcctgaatagctctgaatttttaatcctggtttgtgttgcattggtttatatgggatgtgtcctgagtcattgccaggtttagacattatttcccttctgccatctaaaaccttttagattacttgcattttgctactttagtctcctgatttttaaaatatatggcaaaatttattgtgcgatttatttcttgttttaataaagaacgacgtggttttttttttttttaagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagaaacttaattcttccttcttcatagaaggaagactaaggattgtgagtttgtagcatgattatttttgttttagtctccagaaaatccatcaaagatgcccttcccctataaggtgctcaaagccctggatccagaaatctatcgtaatgtagaatttgatgtttggttggacagcagaaaaggtaaagaaatatcaacaggatacttttgaatcctgacaaatccaggagtataattttgcaaattatggtgaacatctcttataagaaatactgttataaaaaatagcctgatgctttttatcttactttatatatgatttaaatccaaaggagggaacatagctttagaagtgggagggatcttttaaagcctgatgtttgcctgggacttcaactttgcaaagactgtgtggagacaatttttagatagcattaagaaacttagtgactgaaaacaagctcatcttaaattccaggtgttaagaccaccttccttgataaatgagtaggttaggcctgtgggtcaaatctgacacaccaactgtttttatgtggtctatgagctaagaatggtctttaattcttaaatggcagaaaaaattaaaagaataatatatcgtgacacatgaaaattatataattcaaatttcagtgttcataacattttacagcagagtttgagtagttctgagagtcttatggcccaagaaactgaaaatactatctggctctttatggaaaaagtttaccaacccttgaaaataggtcattgtttctctccttataagataactaaagtgatcaacctaggccttaaagttttgccttcaagataagcctttagtatttcacattcaactccttgaaccctggtaaacctagctgtagttaacaatctagaatgaggttaagaccttgggaaacacagtaagttgttaaaaaaataataggttgatttgagaagctgaataatgttactttcaaattgtacctcgttagtgtttgactatctctgattacaaactcccaatttccacctatttgttttttaaagcacaaaattattctggcacgtctttttaaattgactgcagaaataactcatccagaatgatagaatcgccctttgggactttacccctattttcacttatagtggtagcgttgtcaaaggcactacggtaaaagtaaatgaggaaattaaatgatataggaaaggaaccagtttagttgagcttgaatcttcattttcttttaatagaacttcaaaaatctgattacatggagtatgctgggagacagtactatttgggagacaagtgtcaggttagttccttcttcaagaatcagtaatttttttaagaatgtgctttttgtcatgatatgagttgaacaagacttatttacaaagtactagaaactttttatttatatttttaaagagatagggtctagctctgttgcctaggctggagtgtagtggcatgatcctggctcactgcagcctcgaactcctgggctcaagtgatcctcctttcctcagcctctctagtggctgggactacaggcacataccaccatgcctggctaattttttttatttttatttatttatttatttatttttattttttttttgagacggagtcttgctctgtctcccaggctctggagtgcagtggcatgatctctgctcactgcaagctctgcctcccgggttcatgcctcagcctcccaagtagctgggactacaggcgcctgccaccatgcctaattttttgtatttttagtagagacgtggttccaccgtgttagccaggatggtcttgatctcctgacctcgtgatccacccatctcagcctcccaaagtgctgggattacaggtgtgagccagtgcacctggactatttttattttcttttatagaaacagggtcttactatgttgcccaggctggtctcattcctggcctcaagtgatcctcccaccttggcctcccaatgttgggattacaggcatgagccaccacacccagccgaaaaaaaaaatgtttctttaatgtctgtgttaaattttaattacaaatttagtgattagatgtaaggttctttcagtatgtgctgtctccattgatccagactggcagtgttgatacgaattactttaaaaagtagacactgaactccatttggggaaaagtggtattttgtttggcattagctgtatctgtcactagtcttgagactagaagtattctcttttcaggtttgcttggaatcagaaggaagatattataatgctcatatccaggaagttggaaatgagaacaattcagtaacagtctt

SEQ ID NO: 5846 - DNA, 308461 bp, human; identical to SEQ ID NO: 4926

SEQ ID NO: 5847 - DNA, 49406 bp, human; identical to SEQ ID NO: 4928

SEQ ID NO: 5848 - DNA, 49496 bp, human; identical to SEQ ID NO: 4929

SEQ ID NO: 5849 - DNA, 48780 bp, human; identical to SEQ ID NO: 4930

SEQ ID NO: 5850 - DNA, 103885 bp, human
cctccgaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtaagtgactgcagctatgacaggaagccgggcatcccaagccccccgcatctcctgtgtcttccccctacacccctcccaggtcccgctgtgtccgccaccgctgttcctccccgtctcactggaggacttcagaacccagacctggggcttcttagggcggggtgactcggagaagggggagtcagccacctcgggcagcctcccggccgtttccctactgaacggtcccagggtcggtctcggagcccgtttctcttctgatccagccttctgtgagggggaacagcttacgtgcctgagtcggagatttgtatctgtggggttctgagcttacctttcaaacatccgttttggcctcggggaccgtagattaaaggagcagtaacaggagaaatgtaacttgtagttttttattctcccgtttaccgctaacttacctattcacttcagaggtggctgtaactctcccctatttgccgtcctctttttcttgcacacagcgaaaaggagcggggggaaggttgggtatttgcttaagaaagtcctctagcgaatgtactctagatcaacagtgttttattaaaataacaccttatcgtgaggtaaaggaaatcgaatacacggtccctattaggcagaatgcggtctaaaaggatggccagacagaagaaatgtgcacaactgactgcagagggacaaacaagtgctgagtaatctggtgattggaaggagagccccagctttgtgttctttatctaattctgcaagatgttttagtggtgattaatatgggtgattctgaataggaagtacagtagttggaatgctcgcttgactaggacttgtatttacttacccacttctccacttttcaaagttggggtagtgctttaaagcgatttcgccgaactcccctacgaatgtacgtggaaatagaggcagtgaaatatattttcatgctgtaagaacttgaggattggtaaaatgtagatgttagtataaaggactaatatggttcgagaagttcactgccttcaattctcacacttactccgtgggagtaataacccgctgtgatgcaagtatagttagccatgcatgctagaagtcattctaaaaactaatgtatgtttatacacaatatgcaccaaaaagttacagtaataaaatcagaaagcaatgtacgttggtagatttcagatgtttgtctttccaccaaccttcatgtcactgttgtgggattttggggtggcagtggccaatcttgagatgacaccgaatctccttcaagttcaatatctgagacaagtttagagctaggtgtagagcataggaaatacatttgggttttgaaatgtattggacttccgtgaaacttaatttttgtgtgtgtggttttcccttcaaagtaatgaactgacaattcagattgaatgagacaccaagtcctttggtacttttgtgtgtgtgtattggggtgggggagggaaatcatcagtttatgagctgatcagtttagaactactctgtggatattgttctttccactgaataagtttaatttcaaaggacgcaagttatatcaggacctgtgtaaactgtctagtccagtacctgggcacagagaaagcattcaaaatgttcatgcttttctccttcctttcttggcattggcaaatttgttaactttacacaaagcttattttgggagatatatagaacttggacctattttacttatctaaaccggatgagtcattttgatagaattgatagagtcacttcttccctcatgagataatacagcttctcaagcactttgatcctctgatattaggtgaaaactgaaaaaggtttttttggaactcagctttctaattttaactttaacctgcccaattactaagtgtgttgagttctatggataaaactacagggtcagtttgtggatttcagggctcctttctgtattagaggattggaaagacaatagactaatctggagaattgcatctgaaaagaactggcagcactgagggcagaaaaaggttagcatcatttacattttcctctatcctttgtggaaggttgtatcatttgcataagacaccgtgaggagatctgggtgggcaacttataacctagaaatgtagtgagaaatcttgatttgtggaaacagattgccttactagatattggtcatcagaaatatgttctgttccttcatatgatctggagtggcaaactatacaatttctaaggttaatagactgaatttgggcacttcagaaatgttccttgctgttgtgtgtttgggagtacacagactatgtcaacaaattgtagtaaactgaataggcagtggagacttatctcatgttttgttaattagcacaatcctaatacacaagctatttcctaaaattaatttatttcttgcattttccttccaatgatgtcttcggctttgttaatctactctttgaaagcaaatttaataagttaaaaatcagcccagtttttttagagacttttaattccagtacagcctacttttctacagtggcagatgatcttcacttgcccagctttgcaatatatgccgtatttataatgcttttttattgatattttaggtcaggttttctttattttcttttttcttttctttttttttttttccaagatagggtctcactctgttgcccaggctggagaggtggtgagatcatggctcactgcagcatcaaactcctaagctcaagttatcttcccacaggtgcataccaccctgctcagctaaaggtttttttagagatggggtcttgctatgttgcccaggctggtctcaaactcctggcttcaagtgatcctcccacctcagtctcccagggcgctgggattactgtcaggcatgagccatctcgccaggcccaggttttctcatttttatcttcatttttacatatgaggaacatttttttttttttttgagatggagtctcgctctgtcgcccaggctggagtgcagtggcacgatctctgctcactgcaaccttcgcctcccgggttcaagagagtctcctgcctcagcctcctgagtagctgggactacaggtgtgcgccaccacgcccagctaatttttaggagagacggggtttcaccatgttcgtcaggctggtcttgaactcctaacctcatggtccgcccgcctcggcctcccacagtgctgggattacaggcgtgagccaccgcacctggcctaggaaccttagactcagagacggttaagtgaatttgtcctaggagagagcttttaagtggcagaactgggatttgaaaccagctcttcagactcctagtccagtatttttttttttttttcctgtggagggcgatgagagcagtgacagagaggtggacagagatcctcccctggtaaattctggagtaaaatgctttaggaccaagttgctgaattgaactgatacatctccattaaaaccagcagcctaaacttttttgttctcttggcaagaaattccactttctttcagcaacgtgtatttttgttttgtcagataggaattttgcaagatcatagcctgttgcagctagaagggacatctagttaaactccttcgtgtaaaatgttgtgaaaactgaaacctagagagagaaagcaacttgtaaaagctgccacagcaaattaatggtggagctaggtctagaacccggatcagtttgactgtctggcgttctttctgctactgggctgtcttttgatagagcaggaaagagaagaggaatcgtgtggtacactagaaaagagccctgcactgtgagtcattttatttcctcatctttaaattgaggggattacactcttgagaacccttccaactctaaatgtctttatattgaggtttaatagtgtgcttgtattgataagcttttgttcttggtaaatctttcgtgattttttttaatcttttcgtttaacttaatggtatttggtacatagttcaagacccataaatttgaaattaagtatttactgggtaaattatatatgagatgaatgcccctgctaactcatgtggtttatacttacacatactaaaggctggcactgagaacatgttgtaaaaataaatgtaacattttcagcactcttttttttagtggcagccaaaatatttttgaggccttggaagaaggatagaatcataacatttttagagtaggaagggactggagatcattttagcccagccttcccttttaactgaaagtgaaatttagggtctgagaggggaagtgacacattgctaataagggcagacttggaactagagcccaggtctcttgattcctcacttataccatgctaccatgtctgcggaagaagggaaagtattgctggctattcctgccataggtttctggcacttaccctattagctgggcttttaagatggtttacttgactgtttcttcataccttgcctatcagaggtcttgaactattttagaatcctaagttttgcttacgagttttttccaagtgaaagtgaaaaacaatggcaaaatagcttgtctaagaacagtgattatttgtattattttattcttaggcatttagttagtattaactgcaatctaccatattcagataggaataatgataaaatcttaagtcatgggaactgagaccaaactgtcctgaataattgttaggtctgaaaaacaaaaaggtgtgtagctgcctttgttgaaaactcagcttctcactttacttaggtgtcagaaacatttctctctgaattgaaaattgatacaagttttaatttaaaaaatacctgtgcaatatttattactttagggaagtttccttaaaaatggctgtttgttgatgagttgacatttgatcacaaatttgattactgaaggctttaaggagtgatagaagtatatttacaaatgctgttttatcgcactcatgtaacatcatattgaagtgagaaaaaacaaccctctacatattagttagtaaattcaagttctaaatttagtgacatccggccgggcaccatgactcacgcctgtaatctcagcagtttgggaggctgaggcgggtggatcacctgaggtcaggagttcgagaccagcctggccaacgtggtcaaaccccatctctactaaaaatacaaaaattagccgagcatggtagcacacacccagctacttgggaggctgaggcaggagaatcgcttgaacccgggaggcggaggttacagtgagctgtggtcatgccactgcactccagcctgggcaacagagcaagactccgtctcaaaaataaataaataaacaatttatatttagtgacatctgactgtcagttggtaactcatgggggtaggatagtccatagtggcatggcaatttgggggctcaagttgaatctgtataaactcctgtaaattggaaactgtattctcttcttgtgataatctacttcataagataggacagataaaatttgtgttgtttgttttttgttttttgtttttttttttgagacagggtctcactctgtcacccaggctagagtgcaatggtgcaatctcagctcactgcagcctcgacctccccaggctcaggtgatcctcccacctcagcctcccaagtagctgggaccacatatgtgcaccaccacgcccagctaatttatatatatatatatatatatatatatatatatatttttttttttttttttttttgtagagatggggtttcaccatgttgcccaggctagtctcaaactcctgggctcaactgatccacccaacctcgacctcccaaagtgctgagattacaggtatgcaccactgcacctgtcccttgattttaaaaaatattaaaaacctaaatagttttaggatgtgaagtatagtggtggtcttaaacagaaaataatttctaattattggtattttagacttactgtctaacctttacattacccaacactccatgtgtttgtactcttaagttcattgttaagactttgacagaatcaggtgaatttgccaggcaagcacctttaagaggctgcttgtttcctcctcatactctgcaattttgttagttacttcctggggtagtagtggaggtggaggaagggagtataaagagatcatgcaggttgtggtgatggaggtggaagaggtaaaggtagccccagcagtaggtatagagaccaagttacagtgctgcttcctggggcatggataactgagataagacaaatcccatcattttgatacacatgttcacagcatgaattaaataaccccttctctaagagattaataacctataagaaatacctcaaatcaaagttaaagtaacaaaaattgtaggtactttatgatgtcctactgatatttagcttgaattgataaataacctatgtttctcatttctatccatagttaggctaatatctacaaactttcacaaggactgttcccctctcactgttggatattattcagctaaccagctaaacctttaatagggtgctttccttactcttcagagtgaaactctttctattcccttatttcaaactcagcagtgtttgtgttagtctgtcatctcatgattcaaaaccgaggaaaaagcacctacgacataatgtgggcctcatacctgatggcaaccctgatgtttttcctcagtcagtatacaaatttatcttggttactatagcaaccagtctatcagttattcttctagctcttttgccttctctcagatactaggattaccatataatcaggttctgccagagcgcttcaggtcttagagttctattaccagctgcaactgtctggcagttcacagtttggcattccatcagagtcagttgttttttaagtccacaaaacctttttgtctccaaacctttttaaacattttaaacatatataatttaacaaaaacatgtttaggcagcaatttcctcatactaattttctcaatccagtgttagtcattgccctgaagattgaatgcattgcatcactgcatccaatagccatccctttataataacaagtagaatcaatttccagatcgagggtgaccatttaggaaatatatttgcaaatgtgattttagactcagtatcatcacaaactagctaaaatgacttaaaagcatcttgatcatcagcagctaccaaataatccagcttttaacaaaaatgatttctataggttgtagaaagaatgtttggcctttagattaattcattttaatttgagaaaactgtttagaaaactaataggaagtgttatcttttgtagcccttgaataaacaggaagagaacagtaaagactgaatagttgtatgggtctttttttttatatttatttgacatacttttttaactcttaaaaatctcagaattcatgtaactaaaatagttttaaattataaatatgtttacctgttttggtcaaaacaaggattggccaggtacagaagctcatgcctgtaatcccagtgccatgagaggctgaggtggagggatcacttgaagccaggagtttgagaccagcctgggcaatgtagcaagacctcatctctacaaaaagtttttaaaaattagttggacatgatggtgcatgcctatagttctagctatttgggagattggggcaggaggattgcttgggcccaggaggtcgagggtgcagtgagctatggtcacgccactgtactctggcctgggcgatggagccagactctgtctcttaaaaaaaaaaaaaaactatagttaaattatgataatgcttcaaggaaatctttaattgtacaaatagacttaagactggtttcactttctccacagagtcctgatctttaaaatttttcaaagggggagtcaggtttttaaaaaatctgaggatgaaatataagattttttgaaacttctgagggaaaacttgaatggtatttttttttattatactttaagttctggggtacatgtgcagaacatgcagttttgttacataggtatacactgaatggtattttctaataggtatcctatacagaacaagccatacctgtaacaagctatctatatctgtataaaacctacttggccactactaattgtaatagactattccagtacaaaactcattgaaccatgggcattcttatgaaccacagatcaaactttctagagaacctataaatagtatgtagtgctgtatgcaaactcactgtcccaggagcaagcatcctgattactaagcaagctcaagagaagaggtgggagtattctttctgacattgttcttgaactggtaagaatagctgtggatgaacttaatatccatagtcctcttttaattctgtgcctgaaagtatttattgaaattggaagactaagggaatcatctttctggttattagcagtactgttaacaattgaattttttttttaaatctgtcttttaaaatatattacctatccatgccaaactaaaatggcaggtggattgaacatttcactcagccccaactccacccctttcactgccagctttttctttcctagcatagtcaatgtcattagtacagagatttcctagtataactacttcttgtcccttaaaactgagaagggtcagtgatggaagaaatataaagggtgggaacttttggaaggagtaagggaaaaattggttgcattggatatggtggacaagttggtaaagactttagtgttacaggtggtgcttagtcattggattagtgaaagatgggtgagcagaatgaacaagtagcttgataaaactagtagctttgtgagtgaaagcaagtagatttgtctgtattttgcaatgggtattttatctttattagcttggcttaagggttaaggttaatgattgagatcagtcctttttcctttaagtgcaccttactgtgcctattatgtcccagatcatagcccttagctgttgacttttaacctttgccttatttcccagcatagtccacagttatgtctagcagtgcacacaaggtttagttggggaggcgggtggtgagtaagcatgctctgtggtatctactgcgcttcacaattggttctgattttgaacttcctggttctctccaatctccagtcacccttaaacacacacaggtaccagttcctataagaggaggtaggtaagggagctgaggcaaagagagtgctttggatgtataggatcttcataacttgaggacatcctatacccagtaaatattaaatgttaacagtaaaaccttgggtggtgttgccagttatcctgcattcctatcagttccttgttaccaacttttttttcaggaatgaatgtgttcacagtaagaaagaaatattatagtgctacatgttacatgcaaagaacgataacaccataacaccataatgctaactaacggtgggcatttgttttcaaagttcttttaaaaagttactgtttcaaacaatgaaaagcagtatttttatgcccttcattttaagctttgacataattgattacggcatggtagccaggtcagaaaatgaccttgcttctgaaaaagctggaatcccagacactgttcactgcatttcaaagagttatggtctttgttcctaagggaaaccccctcaggatatgagccattgctgatttgggtttcagtgccgtgtcaaaaagtcttaatcccagatttttttttttcctacaattgttttatagattgttgtcagttgcttagttaggccacagtactgtattgtgttttgtttttattttagtataactgattcatttttttggccacaagcctctaactagaaacacaatgtttctttttctctttcccttcaaatgtgttttgtagcagtcacagagagtgactgctttgtcactctttgtgactacctacctaatcaaacctctattggctttcaaactaatgggaaaaatgtattcctaatagctgggtaattacaaaaaaattaaatgattagtaattactgtttaagatgtaaataagattgaacaatttgtaataatagtaaagggcttaaacttgatctacatagtgtgttctgtaggtaagcattctagataattgaagatttttgtagaatatatatatcaagtcattgatatatatttctttcttttttttttttttttgagacagagtcttgttctgtcaccaggctggagtgcagtggcacaatctcggcttactgcaacctccacctcccgggttcaagcgattctcttgcctcagcctccggagtagctggcatgccaccaagcccagctaatttttgtatttttagtagagatggggtttcaccatgttggccgggatggtctcaatctcttgacctcgtgatcctcccacctcggcctctcaaagtgctgggattacaggcatgagccactgtacctggcctgatatatatttcattagaaaaagaatgtagaagtagaaattcaagtacataaagcatagaaattaaatttagaaaataaagtacttaatggcagattttactgaaatatatttgagtttttgttattcatgatattgtaggaaaacatgaataattaaaagctgtcagttacacaacaatctcaggtcagtcattagtttaccatcaaaacttttatcaaagataataacagtaggttttctttaattttaaaaaataaatagtttggtttgagttttgttcctctgctcatctttggtgatgagcagtgaactcaaaagaaggaaaacaagaaatcttgaagtctgagtagttcactaatagaatttatcaatttaaatttttaaaaaggggggctcacgacaggtgctttagaatgctagtttttatttagaagttactggcatttacttttaaaaattagtaccccaccaggtgtggtggctcatgcctgtaatcccagctacccaggaggttgaagcaggaagaccctttgaggccaggtacttgagaccacgctggccaacatagtgaaaccctgtctctaacattttttttttaaacttaaccaggcatggtggtacttgcctgtagtcccagctaggtgggcgtagagggggattactggagcccaagaattcaaggctatagtgagccataatcacaccactgcattccagcctgggcaacagagtgagaccccgactcttaaaacacacacagctgggcgcggtggctcatgcctgtaatcccagcactttgggaggccgaggcgggcagatcatgaggtcaggagatcaagaccatcctggccaacatggtgaaacctcatctctactaaagatacaaaaaattagctgggcatggtggtacacgcctgtagtcacaaactagctaaaaatgacttaaaagcatcttgatcagcaacagctaccaaataacccagcttttaacaaaaatgatttctataggttgtagaaagaatgtttggcctttagattaattcattttaatttgagaaaactgtttagaaaactaataggaagtgttatctttcttttgtagcccttgaataaacaggaagagaacagtaaagactggatagttgtatgggtctttatttttaaaaagccatatgtctttctttttttatatttatttgacaaacttttttaactcttaaaaacttcagaattcatataactaaaatagttttaaattttaaatatgtttacctgttttgctcaaagtaaggattggccaggtacagaagctcatgcccagtgccatgagaggctgaggtggacggatcacttgaagccaggagtttgagaccagcctgggcaatgtagcaagacctcatctctacaaaaagtttttaaaaattatctgggcatgatggcacatgcctgtagtcctagctatttgggaggctgaggcaggggaatcgcttgaacccaggaggtggagattgcagtgagccgagatcgcaccactgcactccagcctggcgacagagcgagactccgtctaaaacaaacaaaaaagaaaaaaccaccaccacacacagattagtactccatttaatgttttaggtaacttacaaaaccatattaatatggccaggcatggtgtatcacacctgtaatcccagcactttgggaggccgaggcaggtggatcgcttgaggtcaggagttccagatcagcctggccaacatggtgaaactccatctctactaaaaatacagaaagttagccgggcatggtagcacacaggagctcctccagctactcggtagactgatgcaggagaatcccttgaacccgggaaacagaggttgcagtgagccaagatcacaccactgcactccagcctgggcgacagagtgagactccatctcaaaaccaaaaaaaaaatcttagcactttagcttgataaagcttctgtaatacggcctgtagcccaacatcttgtttactttttcaaaagtaacagtgatctagcatgattgcattagatattgatttctctaggcaggcataaatttagttatctgtttctgtcttgattttactggaaattactttaagtcattaatagatttgacttttattctaacctactttaacaaattgggacatggtgatatagctgccttaccttggtgttattgttttactgcaggtatttattgaatggttgtgaatgtgcagaatagaatgtttttagtttggaatccttgagtaggcccaggaaagtggttttctgtttatgtcagtaaatacattatcaagctgttcttttaggaatatggcataaagctgcactacatacatcatttttgaaaaatcaggttgtcattttagataagatataattgtaagaaggtccacttgaagttttgtaattaccctgtatgtgaacagatgtatatttcacaacaaagtttcctttgatttcattaaagatcatttacaaatattgccacaaaacctttcaaaaaacatagggccattgtgccaaattttctcactatttctattaatatcattgataaaataattattagttaattttagatgtaatctgctatgctttcatagtatttaaaatttaaatgtcctttcaaaaggtaataaaagtaataattcacatcttgaagattcagttaatatcctattggataattgtcataactattctcagctttttgtgaatgttgttaataaaccagtattgctttgcatccaaggaaattcgagtgatttctattttctgctgcctagttacctgagattttgggatgtactaggaaaatcagactaatttatgattgcctagcacttatttttttcctgctgtttttagacttttcaggtttagttggtattatcacttttggtagtagtcaacttaaaattattagtagtcaacttaaaataggactgtgagaatgagagtggtactgttacaaattatttaggtttgaaaggccagcagatgatttttctcttagatgccatttcttcaatttgagtagcactgtctttaggttgaaggtgcttatatacatttcaactccagtgtacagtattacataccacattttaaaagctgtgcacttaaagcaagatttaagaacaaaggagaacagtctcttgttctctaaacttgaagtgtttttaatttttggttcaacctagggttagttttgtttgtttttatttttgttttttgcttcattttttgttgtcatcatttttctgcctggcctcagtgggcccaagaaagagttcttgttaagtgtttcctgaggaccagacacgtgattccctgtttagacttagcacttcagtgtcggtcttagtttgctatcaaatcttactgtttcaacttgctggactttagaaatcaaaactctttaattagttgcttactttaatgactggctaagtccttatctatgctcataccctgttcacctcaaggaccttagaatcctagcgccttctttgtacaggcaagctattctttgctttgcttgattcagttccttggtgcactgcttaagctcatcttacttttatattttctttataacaaaggatagagggggataaaaacaaaatcaagctgtagggtaatttcctggtgaaccttttgtagtcactttcatgtaagaaaaatgtttcccaagcaaccagctttattctagctgactcactttgtactccctccttccatgtcattgctcctttttacctctttaggagtctgttaggaattttgcaacctgacaaaaggcttctgcagagccaaccacctttttttttcctcagggcctgaaaaaaaagtgagtcttcctactgacaggaaaataaaaagagaccttgttagtcaatttttttctgtatgttcaattgttctggtatattcttttccttgagtataaagaaaagtctgaaaataatggtaaaagtgtgagattgctctgatatttcctttttgtactttaggaggtggttctttgagttcctagttgtttagttgaacatgaagcaggtggcaaatgtaagtttagtctacacactgattccttcctgttcgcagaagggttcatgtgttcgtttttaaataatcttcgggtaaggaatagagaaacaccaagcccaagaggcagaaggatctgtctatagctaatgagtgagaaactaactgtgggatggtttatggtctctggctctttgaaaccacagaaatttaaagttatttttaaaaagccaacttgactgggcacagtggctcatgcctgtaatcccgaggcaggcggggggccaaggcagacagatttcttgagcccaagagttcaagaacagcctgggcaatatggtgaaaccccatcttctcaaaaaaattaaaaaattaaaaaaaaattagccatatgtggtggtgcatgcctgtagtcccagctactctggaggctaaggtgggaggatcacttgagcctgagaggcgaaggttgcaatgacctgagatcatgccacactgcactacagtctgggaaacagagaccttgtctcaaaaaaaaataataactacacctaagcacttacaccattattttaagtcctgattactttaaggccataccacatgagtgctgaagatctgagtttaaaattggaaaaggtgttcctataattgcctggagaaaaaccaataattgcccagagaaaaaccacttgcagaagctatgaaaaaccaagttagattcctactagtcagccacgtcagtagctgatttcaaaatatgagttttgcagtaagccaggcaagacagtacaagtagcttctatttggggaatctaatctatataggttcttaatacatacttgcattgattgccattcaaatctaggagctattagtgcttcagctgtgggaaaattgtgagattatgcattgacagaattgagaagcaaattctacttcacgttgcagaaggctcatcagattttagattgatatagaaataatataacgaatatttctactacgctttttgtaaagtgaggagactgttctaaagtgactttgtatatgtaataactgaatccctttttaatgacaaaataattttaattgatatttatctagaaagttggttgttgatggttatttgacctatacaggttaacctcattttgaacatgttgactgaggacagtttcagtgattataagtcaaatcacatatctagagattttgtcaatgtattacagtagccatcttggttttgtggggcaatctaagccaaaaaataatgaagctgtttatataccttcctgctttttgctgagcatttttgataaatgtacataataccatacatgtagtatttgcatttaagcctattcagtgcatgcactgtctggaagagctctgactaaatagacacgtgcaaattttttccccattcagtgaacactattaaaaaatcagatgaatatttatacagtggcattggccatgcaattcttcctgctttgtccctttatcacacactaacagaacgtaggattaattatccacctaattaacttgggggtggggtagagttgctggataaagtacaagacactcagttcaattccaatttcagataaacatactaaaaatgtattcattgtttatctgaaattggaattgaactgggcatcctttatttttagttgctaaatctggcaaccctaggtggggaagaggcaggagactagtagatataggcacagttgtgagatttaaatacaccatgcaatgacaagagtaacctttactctcacgggaatactaagtgttttttagcgcaatgctatttattttagtgtccaatgcttttttctttttttttgaaaatgcatcaatgctcaaagctcaaaaatagtaaaacgtggctcacacttataatcccagcactttgggaggcagagaggcaggcagatcacctgaggtcaggagttcaagaccagtctggtcaacatggtgaaaccctgtctctactaaaaaaaaatacaaaagttagccgggcgtggtggcaggcacttgcaatcccagctacttcggaggctgaggcaggagaattgcttgaaccgggaggtggaggttgcagtgagccaagatcgtgccgttgtactccagcctgggagataagagtgaaactccgtctcaaaaaaaaaaaaaaaaagggagaaaaaagaaaaaaatagaaaaatgtaacaacatattgtttagggatacatgcacgtatgatgaactgtttttgaaaacaaaaaattaagggaacaataagcgaaatctgggatagtggttacctctaagggagcagcaagcagatggaataaagcacatagtagctgcactggtattaatgctaattctcagttaatgtggtaagtgacaggatgtatttttttatgcttcataattacgtgtacacattgcacatatcaaatacagaatagcattttaaaagataagttaaaacagacttcaataagaaaattagcctatgtgcaaaatttaactgtatatactttctaaaataaatccaaaatccaaaaagtaaggtcaaaaggcattctgaaattttaccagtttgctaaagatcatattgagtaattaatagattctagaatgattacttatctgctgtaatacatctaaaataattaaactctttggtttgtgaaaatttcatttttattacttgatgtctacagtggtgaatcttcagtttttgtctttacttggaaagattactgattgttcagatatattatatgccaaattaaaggaaagaaaaacagcaggtagagcatgcattaagtgattaattcaaatgagctaggcctaaactttaggattcctggaacaaaaaatcagaaatctctgttttccttgattaatttttaaaagttagatttctaactcctcgtttgtaaaaactattatgacagtctacaatatccatcagtaagcagaaaaattcatctttagcaagtgccagtttagagcattaagctgaagttagtgtttagtgtaaatttatttagtgttttaaagcacttctagctctctgtagtcttatataattttgtcttgtagaaatagctggagggtctattccagaaagcctatccaaatatgtcctcttctcccacttacatacacacttaggtgcccctcctctgtgcttcaaggttatcatgtgcttgtgtctctcattgcaattgttaccttatattgaaattatgtgttatattttcctcagcttatcagattgtgacctttctgtgggcaagggctggatctttctcaccctttgtatttcaatgcctgaaagtgcctggcacatggtagataaccaataaggatttgttgactgaatgaaggggcctaaagactcaactaatacagctccttcattttacaggtgtggaaactgaggtttaaagagattgtggctttagaaatagaaacaagaccacagagattgtctgttccagccttctacaatatccctattgagacatcattgagtttctgttttaatactttatcagggaagcagctcatggctttttctaaactcaggttgttactgagattgttaggttgaacaaaagcctatctctttgtaatttctactcttagtcctagttctgctgcataatgcttcaaacatttgaaaacaactacttttcttccttatcttcttctggttagccatccttagttctttatatcattccactcagtttctagaacattcaccaaattgatttctctcttctgagtatgttctgtttcatcagtgttccttttaaaatgaatctcaaaaagtatatgatgttcctaaatgtgcttttatcagtaagaagtagaagagaacttaccattccccttgctctggacatgatagttctgataattcagcctaaaaacacagtagttttggcagccatatcacagtctttgtctgagcaatcaaccaaaatacctaaatgttttcacatgatttgctgttaagccatgtctctcccatcgtgcattttacatttatccctactacatttcataccgttaagatttgacccattgttctagcccattgaaatattttggtggccagtggcagtggctcacacctgtaatcccagcactttgggaggctgaggcagaaagattgcttgagcctgggaggtcgaggctgcagtgaaccatgatcgtgccactgcactccagcctaagcagcagagcaagaccctgtctccaaaaaaaaaagaaaaaagaaaaaagaaaaattttggggtcctgtcagccagtatattacctgtctctctcaactttgtgttatctgcaaatttagtagatatgccatcagtatccttatccaagatattagtaagaacatcaggtagggtagaaagtaatttagtgcttaaaaccggatttttgtgtgtgtgcaatattctcttttattctaggccagtaaccctatcagaagaggaaattaggttaatcttgcatgattggcttctgtgaatgcttgctgactcttaatgagtatctttttcccttgcatagggctcttaaacaattaaacagtgtttaagaaatttgtttggaattgacatcaaatcaatctgtctgtagttggtggcatctaggcatctacctgctttgcagagttgactattagtgttttctttacatcatccccttccattcccctgattcttcaaaggttttagatggaaattgagctctgcaaattctcagatacactgggacataatttgggagagtagaatggaagtcacttataatattaatagttaggtacttttatctccttgaatgctttgggattcagtttcctcattctacaatttgtttttccctttctggtttgactatcagtaatcttaatagaaaaaaaagttgagatagccttttacattataataacgtatacttatccatatataagtagacctgcactttatatttgttgtgcttgttctgagtataaattaagaaaaatcttgtctccggtattttttttaaatcttagcacattctgagtgccagcctttctgataatgttcttacaggtttttgcaatttttcttggatatgtgcccattccatccctccaatctctcctgcatgtttttaaaaaaatatttcttctgacatgtcaccatgaagatgcaatcaacaaaattcagacatgagaaattctacaggatgagcaacctactttcttcaacacatgaattgcaagaaataagagagattgaaggggaacctgctgatttatcgaaagagacatatcaactgattgtaatatatggaccgtatttgattgatataaaccaaacgtacaaaaatttgggcagtctgggaagtctgaatgttatataacagcatgttatatataatatatataatctattaatgtatataataaggaattgttaaattttatagtagtgttgtggttatgttttaaagagaaatctttgtcctttttagatgcatactgaaatatttatggttaaaaatgaaatggtttcggccgggcgcagtggctcacgcctgtaatcccagcactttgggagaccgaggcgggcagatgacgaggtcaggagatggagaccacggtgaaaccccgtctctactaaaaatgcaaaaaaattagctgggcgcagtggcgggcgcccgtagtcccagctactcaggaggctgaggcaggagaatggcgtgaacctggaaggcggagcttgcggtaagccgagatcacgccactgcaccccagcctgggcaacagagcaagactccgtctcaaaaaaaaaaaaaaatgaaatggtttctgggatttgcttcaaaataatctggcagaggggtggaagaggagtactgatatttttatcattgttgaacatgatcaacatgttgtatatttgggtttataatattattctcccaattttgtatatatttgaaatagccataagtaaatgttggaaaaactccccctaaatatttattgtcacatagatttttactggcagatttgggactaaaactcaggtctcctgattctgctctttttttgtgtgtgtgtagctaaaattatagctcttgtactttcagattgatgtcatgttgtcctttcagtctctgggacccccaagctttccctgagaaatttgtggtagtacttgtagataaattaaggccttactaaagggtcacagtttcacttgactggctacctacctatgtgaaaccataagggacattagacttactagtgtagagaggctgcatgggttattagaaccagcaaagaaacttgggtcctagtcttcactaggccttagcataagttctaagatggcagggaccatgtctgttttgttcactactttatactcaatacctgggaccatgccaggtacatggaaacaatcagtaaatgttgaattaatggattaatttaaccgatggcataatttccctcacatgtaaaatgagacagttgatctaaatgattcttaagtttccttcaaacactgaaaaaaaaagtactcttgccttctgactgatttttttaaaatccttttaggattttgaaaaggattactgtaaatttctttaacactaggtgacatcagtaggtaatatgctcactttgaataactgttatagaaaaaccacagttgctatattgcatcaaaatctctttaaaaatagactactgttatatattttctgttagattggtatttatttctataaagtacatgcatactgttctcaacatactaaattagagagtcaggtttagcaagttccaaagtgtagccatctaagaaggttactaaaatgttccctttgcttgcatacttgtgctttttgcttcagttgtattgaatgcagtactattatgtcagagtttataaaggatttgacattttgcttcccaaggaaaaatcagtgggcaacttttggttaagtggcagttattgtcatcgcatcagtgactaggctcctatcattgggagtaatgaccttattatgaaattttgcttcaggtatctgtaggttatcgctgaatcaggtcagagtttgtaaaagaaaactaattcctataccgttttataaaatcaccagaacagtgttttgaagccacatacatgttttgaaatagtgactatatatatatatatatatatacttcttgaggacctttccgcattcctccagctccttctgaagccttgtcttggctgatacatggatgttgatgacctctcttgttgcttctcccagcagtgtttaccaagggcctttgggaaaggtttgcatgacatcacagggcagctagaggggagaagtgttgggagactggaaaggcctctgtgtgatgccactaatcatatgaagtagcaatccacatactcttccttttttttttttttttttttttggagacagaatcttgctctgtcacccaggctggagtgcagcggtggatctcggctcactgcaacctctgcctcccgggttcaagcgacactcctgcctcaccctcctgagtagctgggactacgggtgtgcaccaccacacctggctaattttttttttctttttgtatttttagtagagatgggatttcgccacattggccaggctggtctcaaactcctgacctcagacaatccacccaccttggcctcccaaagtgctgggattacaggcatgagccaccatgcctggccaaaaataatttctataattaaaatgctaaatgaatagggactggagaaagcatgtaataaactattttatattcagacatgagctttgttaatataaactaaatgttagctagtgtactagtgtatgaaaataactttcttttttattttattttattttttgagacagagtctcactctttcacccaggcgggagtgcagtggccctatctcggctcactgcaagctccgcctcccgggttcacgccattctcctgcctcagcctcccgactagctgggactataggcacccgccaccatgcccggctaattttttgtgtttttggtagagacggggtttcactgtgttagccagggtggtctcgatctcctgacctcgtgatccgcccgcctcggcctcccaaagtgctgggattacaggtgtgagccaccacgcccggcctttttttttttttttttgaaatggagtcttgctctgtcacccaggctggagtgcagtggcgggatctcggctcactgcaagctccgcctcccaggttcacgccattctcctgctcagcctcccgagtagctggggctacaggcgcccaccaccacgcctgactaattttttgtatttttagtagagatggggtttcaccgtgttagccaggatggtctcaatctcctgaccttgtgatctgcccgcctcggccaccaaagtgctgggattacaggtgtgggctaccacgtccagccgaaaataactttctaatagaaaacaggatataatgcattaaaatgttctatttatattgaaagttgctgaagtactaatcttaaaattgcctttatattcaaaacctaagtggaagacacactaaataattttagtatttgatctgtaagccatgtgggttttttagtagaatatcagtacttatttgaatcagaatttattttgaagctgtttcagacgttgctttttgtgtttaaattcattggcagcattgatagacactgtcttcaatttcagaaactatgctgcaaaatcaaaattttgctgtttttgacattagtctaggcaatgatattttggatttaaccccaaaagcacaggcaacaaaagcaaaaatacacaaatgagattgtgtcagactaaaattggtctgataaaattgcacagcaaaggaaacaacagtgaaaagacaacctacagattgggagaaaatatttgcaaaacatatggtttagatgttttgtgccctccaattcttatgttgaaatgtgaccttcagtattggaggtaggcctagtgggaggtgtttcagtcatggggcagatccctcatgaatgtcttggtgctgtcctcacgatgaatgacttcttggcctgagttcacgcaagatctggttgtttaaaagtgggtggcatctcctcccccactttcttcctgtcttgctatgtgatgcatcccttttgcattccatgattggaagcttcctgaggccctcaccgggagcagatgctggtaccattcttcttgtacagcctgcaaaaccatgagctaaaataataaacctcttttttttttttagacagagtctcgctctgtcgccaggctggagtgcagtggcgcaatgtcggctcactaaaacctccaatttcctggtttaaggaattctcctgccttagcctccctgagtagctgggattacaggcacgcagcagcacaccagctaatttttgtatttttagtagagatgagttttcaccatattggccaggatggtcttgatctcctgacctcgtgatccacccgccccatcctcccaaagtgctgggattacaggcatgagccaccgtgcccagcctaaacctctttttttttttttaataaattactcagccttaggtatttctttatagcaatgcaaatggactaacacaccatacatctgataagggattaatacccacagtatgtaaggaattcaaacaactcagtagccagaaaacaacccaatttaaaaatgggcagaggacctgaacagacatttctgaaaggaagacatacagacagatggccaacacacagtggaacactattgagccttaagaatggaatcatgtcatatgtggcaatatggataaacctagaagacattatgttaagtgaaataaaccaggcataggaagactactactgtataatctcacttgtatgtggaatgtaaaaatgatgaactcgtagaagcagagagtagaatggtagtttccgggggttgggggagtagggagcagctgaggaatgggaaaatattagtcagagggtacaaagttttagttaggaggaataagttctggagaactattgcacagcatgatgactataataataacaatgtatgtttcaaaattgctgagagagtaaattttgaatgttctcaccacaaaagatcagtatgtaaagtgaagaatatattaatttgcttgatttaaagatttaccatatttgtaattagtattaatatgttggaagtttgagttttgttttgtttctgctgttaggtgagcaaggaagcctagctcttgaaatttgtatttttgttcaactttgtaagaagcatatttattatttaaataaatatttattgatcagatagtaaatgcatcagaaatatttgatttaaaggtgccctatgatgaaagctttggaaagaaaaaatgaacttttgaagctctcattttggtttgtcgggttttctttaaaaacataccaccaatactcaaatatgtctacatgtaacttcagagttttctgaaaaattttccgtgtgtgtggtttaataaagttattttatgtagacatttgaactttttctgcaaaaaattaccttaatatgtaaaaaggataaatccaatttaccccatttagtatctatagaatattttgaagaaatatttttctatttttctttttttatttcttttttttttttttagctcctgctatcactggagaaaaaaatatttttctagttaactagatgtagcaaagtattattggacatttctgggtatgtacgtgtatgtctgattatatccgtgttttatataatatatttcaaatttaagggaaattagaggatataatatttagatcattaatcatggtacaaattatgtctccactctcaaactaatggtcttaagacaaaattccctaaaattataggaactctaaaatcccttgcttaagatatttctgctagttagtgggagagctaagagtagaacttaattttcttgacatctagttccccatttctccctcccatccccaaacttgaacatgaatagttgttttctttaggcacataaacactgaaatagtctactgttactatctctactttgacattagagacttatttacagagaatttttgagttgtctaaggatactgaagattaataacacctcacttatctgttggccacctctgtggtaatgacagttctcaagatacagctgaaaacaagaaataagcatttaaaaagcctctgaacagttcaataaaaaaaaaagtgccacaaagttcaaaataagattatgtacgtaaagtctcatggggagacccttaggatccctagattctcccttcaccatacaatttcatattaaggaaatctggtttcccagctcaatgcagattagaagcacaagtgagaaggatggtgggaagaaagcttttaaatgcaggcgcatggctgactgtaataagccaccgcttataggctgggtgcggtggctcacgcctgtaatcccagcactttgagaggctgaggagggcggatcgtctgaggtcaggaggttgagaccagcctggccaatgtggcgaaaccccatctctactaaaaatacaaaaataagccgggcttgggggcgggcacctgtaatcccagctacttgggaggctgagtcaggagaatagcttgaacctgggaggcgggggttgcagtgagccaagatcatgccactgcactccagcctggccaacaagagcaaaactccgtctcaaaaaataaaacaacaacaacaacaacaacaaaaagaagtgaccacttaaagtgaggaaggaaatataaaactataaaacacagacattccaggcatagtaacttagggtccttgaaggcaaataaatctgcactttagggtccctaaagtgtattaaaatataatgtagtatttgagcgtgataattaagaaggacaattgtatatcctttgtttaagaagatattttcagggaaagagtactgaaactgcaaggtttaacctactcatgtacttatttacaagctgcttttgagatttttaaattcaaaaatagttaaaatattatcaaaaatttggcactcaaaagcttcatctctctggaaattttacatgtggaacgtttcattatttcattccctagcagtccaaggcaattaggtgttaattgtagttgttaaaggcaggtcaggattcagagcctttgacttaatcagtttagtccaattcaagaagcagcgttaattgcctttactttggtgctcatacacagcaccagttacagtgttttcataattatcttcttttaagtccttacccagagaggaggcagtattgcgaagtggttgagagaatgggctctggagtcaggctgcctagggtcaaattctggccctactgtttactagctgtacaatgtaaatgacctaatctgactcaagccagttttttgttatgtaaaatagagcaagtaatataaccacctaataggagggctgtgaggaccaaagaagctaaaacatgtcaagtgttatagtttttggcaaatgcttaataaatgatggccattgttttattttattttattttattttattttttcattatactttaagttctgggatacaggtgcagaacgtgcaggtttgttacgtagatatacatgtgtcacagtggtttgctgcacccatcaatccgtcatctacattaggtatttctcctaatgctatccctcccctagccccccaccccctgacaggccctggtgtgtgttgttcccctccctgtgcccatatgttctcattgttcagctcccacttatgagtgagaatatgcggtgctttattatttttacaaggcccctattaggaaagttttgtgtgataatactaaataatgttttttattgcttcttagggtgaaatgaattggttttttttcatcttggcacatgatacaaatcattttagccaactttgcaagttataaatatgccttcactttttactaggcattaatgttctacaaatggatttagaaatttgtcacaaaggaattctactcttacagattaccctgttaaagacagttttaggcttaatagacttgaaattgtagtagtttgaaatgttcctacctaccaaggccttaacaactttgtaacatttaacatatacctcaaacatgagtgtcttttgttactagttttttatttagtgatgtcacccagttgcaagcaggatcccattttaatcaccagctcaatatgatatagctttttcatgttccctgtcgttaaatgtgctggaacttgacaggctataggggacctttgctgtattccagaaattggtctcaggctccccactactgacagactgccaaagtgcctttgagaaacttggagcatttcagagctgctgaagagactacactatcatgtgtgtcccatgtactcactcacttcatcctcatagaagttctatgaaatagatggttttacccccttttgcagaggatgagatcgaggcttggagaaatgatttgatcacacataggataaatagtagaaacaatattgaagcaaggttcatctgctcaaaagcctatattttactgtctcctcgtctctcaaaagaaaataataaattactctgtatagtttgtacacagttatatgtaaagccccaccagaaccaatctagaatatttccatatatttccatgtgtgtcagtaattagccaataactttgatcctatgaatcaacagccagagagtactgtttttgaaactagtggcacacaagaaataaatatggcttcctggtttttttttgtttgtttattttgttttttgacagctaaaaaacctgttcagatatctcaaggtgtgagggttgctggaaaggccaagtttcttcccttctctacctcatatggggcttaattttaaaatatcttacccttcttacctttatgcctttgttgcaggtgattggcatcctgaattttgtaccacatggaaatttgtgccccttaaaggtttttcaggctaggtgcagtagctcacccctgtaatcccagcactttgggaggctgaggtgggaggatcgcttgaagctaggagttcaagaccagcctgggcagtaaagtgagaccccatctcaaaaaaaaaaaaaaaaacaaacaggtttttcatttttgctttttaatatttgttgttgttttgattgcacttgtattatttaagatatcaatttgtgtggaatcttctttctttttttgagtatggattagcctcagtcctaactaatcaactctagataaacaggattttgatacattgcagtgtaagtttgtcaggggaccaaaataattagcaatatatgttttcatttctggaaattgtcctttgttaacacatatttatattgaccagacattgtaattaaatgggtactattttatgacaactactttttttgttttctaaacaaatttaactccctcccctaaactagaattttatctaatttatctttgtatctctagtcttggtacatagtaggtaattcataaatgtcagctttgggtgtctggttttattttttgttttgagacaaggtctcgctctgtcacccaggttagagtgcagtagcacaatcatggctcatggctcctgggctcaagtgatcttcctacatcagcctcctaagtagctaagactgcaggtgtgcaaccccatgcctggctggtttatttttattttgtagagatggggtgtcactatattgcctaggctggtctcaaactcctgagatcaagcaatcctcccgccttggcctcccaaagtgctgggattacaggtatgagccactgcacccagcccataaatgtttgttgagtaaagggattgattttctgttactcaaaagtaatttttttaacaaattaagtttttattagaggtcaaggattcctctaccaaaggaatcattacccagtttggcatataaaaacatgttagtaggactcatttcttctcttggttgtgctccaaaatacgactttgaggaaaagtcacttaatctcttggaatctcagtttcttgatctgtaaaaagaggctgtgtgattagatcatcttgaaggtgcctttcaattcaaatttgcatcatgtaatcattggattttaccaaaaaaaaattagaaatggcatattaattatttaaaactttcctattgcataaccccaaggtataactaagtagccttatgctttgaagcagatatcagactgttcctattcaaaaaaaaaatgtgggggaaagggtgaaatggtgaaaagttacttttaaaaattattacatccaggctgggtgcggtggctccctcctgtaatctcagcactttgggaagatgaggcgggtggattgcttgagcccaggagttcgagaccacctttagcaatatggcaaaccccgtctctatacaaaagtacagaaatcagctgagcatggtggcacgtgcctgtagtcccagtacttgggaggctgaggtgggaggattgcttgagcccaagaggttgaggctgcagtgagccatgatggtgtcactgcactcaagcctgagtaacggagtgagaccctatctcaaaaaaatatgtattacatccagagtagtctgtttaagaacagagtcttgctccagtagaaaaatgagctgagagtggtacacagtggttcgttcctgtaatctcagtactttgagagactgaaatgggaggattgcttgagcccaagagttcaagaccagcctgggcaacatagtgagaccctgtctctacaaaaaaatacaaaatattagctgggtgtggtggcgcatgcctgtagtcccagctactcagaagactgagactggaggatcgcttgagaccaggaggtcgaggctgcagtgagccaagatcacaccactgcactccagcctgggcaacagcaagactctgtctttaaaaaaaaaagaaaaagtaaaagctgagaacaaaaatgggtatctctcttcaaaatcgatataaatgtctaatacatatgaaaattttcatccacactggaaatcaaagtacaaattaaaacaccaatgagatatacttttgcctgtcaacttggtaaaaaaaagtttaaaataacacttatttttggtgagggtattaagaaacaggcattcacagagcagtaggagtgtaaacaggtacaagttggcagtttgaaagtagtgttatgtcatatacaactatatatgtacatatgaagataaaagatactcagatctctaggtgataagattatgtatgaatcactttaattttcttctctctcttttttttttttttttttttaagagatgggatcttgctgtctcccccaagctggagtgcagtggcacaatcatggctcactgcatccttgaattcctgggctaaagcaatccttgtgcctcagcctcctaggtagctgggtctacaggcaatagccaccacacctggataatttttaaattatttgtagagacagggtctcactccgttgaccagactggtcttctccactttttttttctttttctttttgagatggagtctcgctctgtcaccagggctggggtgcagtggcatgatctcggctcactgaaacctccgcctcccggttcaagtgattctcctgcctcagcctctcaagtagctgggattataggcacgcaccaccacaccctgctaatttttgtattttctgtggaggtggggtttcgccatattcaggctgatcttgaactcctgacctcaggtgatccgcctgcctcagcctcccaaagtgctgggattacaggcgtgagccactgcgcccagcctctcttccactttttgttttccacattttctacgtgcacacaagacttttcagtcacaaaatatatacacattttttaaatgtggacttgtctgtagtaagtgtatagaagtatttgtcttctcatctcctctattcaacacctccttacttttatttctgaacaggtctccaggaaaagttgggctttcaacattcaaggtaagttgtgctttctgaaagttatgtttttagaaattgtatactttttattcgtgtttttgtgtaattcttcattttcttgcttttgcttttttttacttactttttgctcagtaatgtagtcattatgtcctacttggtatacataggtactctagaaatacctaactaaatattatgctgtaaagaaggaactgtaagtattttttagatttctactgatttttatttgtttataatatctagaataaaagaacgtgtgtgtgtgtgtgtgtgtgtgtgttgaaaaagtgatacttggccaggcatggtggctcacacctgtaatctcaacacattggggggctgaggtgggcagatcagttgaggtcaggagtttgacaccagcctggccaacatggtgaaaccccgtctctactaaaaaaaaaaaaacacacaaaaattatccaggtgtggtggcgcagacctgtattcccagctacttgggagactgaggcaggagaattgcttgaacccaggaaatggaggctgcagtgaactgagatcgtgccactgcactccagcctgggtgacagagcgagactccacctcaaaaaaaaaagcaaaaaattaatacttgcatgacaaaaatgtacagtaactgaaacacatgtatacttcttgtgggcccatgtaccatcactatatataaaaatcaatcccagcttatattcaggcagaggagtttggtattgagatattatgccactgagagccattttaagtataagatatcaccaaatggaactatttatatcagatagagtatatattgtatatgtatatttatatgtatgtgtaatctcaaacatgctatatttttttcagttccagtataccgaccttctgtttatacacattggataccagtctctttgataaattatgatatgtttatatgaaatattctacagtagtagaaatgaatgaattagttatatacaatgacatggatgaatttcagcactagagtgttgagttgggggtaactactcatagaaaaacatatacagtaacgtttcatttatattaagttcaaaagcatgccaaactaaagaatatattgtttagagaatagattgtttagagatacaagcgtggtaaaactgtgaagaattaccagggaatgagaaatacaaaatttaggatatcggtcattctctgagggggagagattgtaatggaaatggagaaggatacacaagagacttgaaaactgataataatgttctttttcttaaattgagtgcttaagaaaagttatatcataactcttacgctaaataaaaattattttgtatttacttaatatttaataaaaacagtctttaaaagtaataacgtgtagggttgaaatttactcaggacaaaaggtatatggttgaaaatgtagctttccttccacttctcatcccccacctctcaaacttcatatccagaggcgattactgtttatgcttataggtcttaaaagccatttagcgctaagatatttttatattataacaaatagatttggagaatttactttaccccgtaattatagattgtccttaacttgagtgaaattagataacaagtatacatatttagtaaataaatatgaagttggatattgttcatttttttaactttttattttgaaataattatagattcacaggaagctttaaagataatgcagaaaggtcctgtatattcttcaccatttccccagtggttatatcttaattatagtacaattttaaaatgaggaatttaacgttggtgcaatgcgagtgtatagttctgcgccaatttatcatgtgtatatttgtataaccaccacaatgaagatgcagaactatttcatcatcacaaagatctccgttgtgctacccctttataatcacacccaccaccttccccatatcatccctaaatctgttttccatctctataattttgtcacttaaggaatgttctataaatggaattatatactatgtgaccttatgggattggttgaaagggtcacgatccatccaagttgttgtctgtatcaatggtttgtttctttttattgctgagtagtattatatgataaacatgtactgaggctattgagtgcatattatgaataacagtatatctattgatattgtaatataaaggaaggcttgatatagttctgattgttggtgattttacagtctgatggaagagacatgtatacaaaagggcaatttatgaggtctcgatgtttgtaaaatagaatagacgtgttaactgccacaaggggtttggaggaacgagaggaagatagaattggcgtgagagcactgttacctgaaatagcagagaaaagtttcagggaggaaatagaacttttgctgagctttgaaaattgggagaggtttgcataggtagatagagaaaaattgggaaagcattgtagttaggaaatagtagggactaataaatatgcaaaagcatgggatttgctagaagcattgaaaaactgtgaccagtgtaaaagtttcagtggtagagtactggaaaataaattgaggccagattgtgatgagccttgaatgtcaggttacctgattttatcataatactatgtatacatgcattgaaacatcacattataccctgtaaatatgtatcatattatgtgtcaattaaaaattaaattataatttagaaaagagatggggcgcagtggctcacgcttgtaatcccagcactttgggaggctgagacgggcagatcacctgaggtcaggagttagagaccagcctggccaacatggtgaaactccatctttactgaaaatacaaaaattagccaggcgtggtggcacatgcctgtaatcccagctacttgggaggctgaggcaggagaatcacttgaatctgagaggctgaggttgcagtgagtcaagattgtgccactgtactccaccctggacgatagagtgagactctgtctcaagttaaaaaaaaatttagaaaagaactctgatctttaaaattttgaagcaggatatttttgggtttcttttccttgcttttcttttcttttctttcgttctttcttcttttttttttttttttgatggagtctcactctgtcacccaggctggagtgcagtgatgcaatcttggctcactgcaacctccgcctcctgggttcaagcaattttcctgcctcagcctcccaagtagctaggattataggcgcccgccaccacacccagctaatttttgtatttttagtagagatggggtttcaccatgttggccacactggtctcaaatgacctcaagtgatctgcccacctcaacatcccaaagtgctgggattataggcatgagccactgggcccgaccagtatatttttgttttttgaaggtctcactctgtcacccaggcaagaatgcaatggcacaatcacagctcactataacctcgaactcctggtctcaaggactcctcccacctgagactcccaagtagctaggactacagactcaaaccccacacccagctattttattttatttttattttttagagatagggtcttgctaggttgtccagactggtctgaaactcctggcctcaaaccatcctcctcccttggcctcccaaagcattgggattacatgaatgagtctctgtgccaggcctaaagtgggacatttaaaaagtcaacttttatatgtcttacagctgtgctgccaaggtggtttttttgtttgtttgtttgtttgtttttgctcgggaactaagaaaactggtggaagggtggaagaaagtttggaggaaaaagacttaggtgcaaagaaagctgtcaagaggcagttaaaatgtcaagacatgagactccaacaaagggaacagcattgaaaggagtggatgtatggatatgacagcgatttaagagttgtttactttttagaacaattttctcagcaaaaaaagagtggaagtcacatttataagtttttctccttttttaaaaaatttcactttagtagcttcccttcccttactactaaaaattaccagttacctgaatttttctataattaatgtttttagcttaatgttctttagtaggtaataatgaagatttctgtgagtgtagatcactttcatacaaatactttgttgggtgtacttattaaaattaaaaagctgaaatcttataaccaaatactgcaggggggttatagacagctctgtaatatccaacacaggtggaggtaactgttacatgaattgctgaaaattgaataagctaccataccttttaaggaagcaaatttttgataccatgatagataggagttagagaaattgcctaatagtagggaagctgggatttagtaagtactgcattttaataatgggtcagcacatcaccagaagtaggtaatggactgtctcaagtatagctaagttggcattggttgtctgtggacacatgcttggcttccattcctttgtcccaaaagcctgatcaaggtgttagaaggacctggatgttatacatcactgagagagaatcataattgactatatatcctaagtctgattttattaagaagtcttctctggagatcaggccctctggtaggtgccatatcactcctttaaacttgtgacttaaaacagcagagtaccttaggagttactatcttttaaaagttcagactccaagagagttttgttaaagccaaataaaatagaagtctgatcactgcttggcagttttggctagtgtaggaatgttaatcttttataagtaaataattgaaacaaattaggccgagtgcagtgacacataggccaagtgcagtgactcacgcctgttatcccaacactttgggatgctaaggtgggaggatggctgcattccagcctgggcaactgcgagaccctgcttctaaaaatcagttaatcaaaatgaggtccaaagattattaatgtgtaattttatgtagcttaatttagggaaaatatccacagaattatgctgtacaatgcttctgattttcctactgataaacagttattagaaaataattggataaaaataattagtaggacagttgaaggtgtttctctaatatgcattaactgttatttatttatttatttttttcttttttcctgcggaccccgttctgctgagagcatcaactattcttaatggtgatcagcttccaagtattctttttttttttttttttggagacagagtctcgctctgtcccaggctggaccaagtattctcttaatggtgatcagcttccaagtattctctctccaccttgtcaaggttatcttatcaattggtcttggttagatttttatttcttttttttaatttctttttttttttttttttttgagacagggtcttgctttcttccccaggctggaatgcagtggcattatcatagctcactgcagcctcaggctcctaggctcaagtagtcctcccacaacaacctccaaagtagctgggactgcaggcacataccaccatgcttggctaattattattttttttagaggcgaggtctcactgtgttgcccaggctggtctcaaactccgggtttcagcctgtgcccggccttctttcatataaaaccaggatccaattaaagcctatgtaaacttaagatgtatgtattaactgaagaaaaaacagagcatgcatcattcaacattcattcagcaaatgattatttagtgctggacactgttttaggtactgaacaaactgtagatagaacaaacaaggtccatctctcatggagcttacattctagtgggacagggaagagacaaaaaataagcaagtaaataaggtcatttcgaacgataagtgcaatgaaggaaaataggataatgttttcccagcaccatttattgagtagggaagcctttccccattctttgttttcatcaggtttgtcgaagatcagatagttgtaggtgtgcggtcttatttctgtattctctattctgttctattggtctgtgtgtctctttttgtaccagtaccatgctgtttggtaactgtagcactgtagcatagtttgaagtcgggtagcatgatgcctccagctttgttctttttgcttaggatttgccttggctattcaggctcttttttggttccctatgaattttaaaataaaatttcctagttctgtgaagaatctcagtggtagtttaatagtaatggcattaagtctatacattgccttgggcagtgtggccattttaacgatattgattcttcctatccatgagcttggaatgtttttccatttgtttgtgtcatctctggtttctttgagcagtggtttgtagttctcctttcacctccctagttagctgtattcataggtattttcttttcgtggcaattgcaaatgatgggagtttattcctgatttggctctctgcttggctgttattagtgtataataatgctagtgatttttgcacatttattttgtatcctgagactttgttgaagttgtttatcagcttaagaatcttttgggctgagactatgggttatctagatataagatcatgttgtctgcaaacagggatagtttgacatcctctcctcaatcccattactgggtatatacccaaaggaatataaatcattctattataaagacacatgcacacacatgttcattgcagcactattcacaatagcaaagacatgaaatcaacctaaatgcccatcaatgatagactggataaagaaaatgtagtacatatacaccatggaatactatgcagccataaaaaagaacgagatcatgtcctttgcagggccatggatggagctggaggccattatccttagcaaatcaatgcaggaacagaaaaccaaatactgcatgttctcacttataggtgggagctaaatgatgtggacacatgaacccatagaggggaacaacacatgttgaggcctatcagagggtgaagggtgggaggagggagaggatcaggaaaaatgactaatgtgtactaggcttaatacctgggtgatgaaataatctgtgcaacaaaaccccatgacacaagtttacctgtgtaacaaatctgcacatgtacccctgaacttaaagttaaaaaaaaaaagaaaaataggataatgtgatagaaagttaaggagtcagctaaggctattttgagatggtcagggaagtattttctgataaaatagcacttgagctatgaccctaatggcaaggaatcatcctattggccagaatgtaattgtgggggagtgatatgagagggagatgaggagtgtagaagatatcaaaaatgtaggcagaggctatgtcatgtttaggccttcatgggccttggtactgtttggattttatctaatacttaagagtccatgaaacatttttttttttctagaagaatctgtgtaagattggtagtattctccaaattctgggggaggaattcagtgctcgaagatattgcaagtcctacagaaatttcactggcacgttaaatctttaacattttaataatctctggagtaatttcattattgagcctattgtgatcatatcctgatacttgtataagtgccacctaaataattaatgtgccttgagtcctttatctgtctaaaatggttataatgaccttcctctaacaaactctgtgatgtgcacaaagaattatggttttttttcctcagtatcaagagtagcattcaaattgctgtgcttctataaatagacaacttaagattgagaagagtattgtattgagatttgcaaatatatgattgtcttattttaccctaattttttccagcagaaatgcagtatccatttctaacctcccaaatatatatatatatgtacgtatgtgtatataaatgtatacgtagatatatatgtatttttggtgggtttaatttttttcatcttttttcatagtttttttaggggcttcatttaacttctggttaagtcttgatttcttttatctaaagcatgtagaattttaagaaaactattccctgaatgtggttttctgtgttataaacttttgtatttgtgcatatttatggagcaatgctttggggaaaataacaatttttattcagccccttgcttaaatccttaatcctttttagctataaaagtacgtagaagttcttatcgtccattacagttttttaatgttaaaaagttgagcaagttttcacatttaaaggtaaatatcctattgcagaataatagaatattgctgatgggtaactttcttatgcaaattacattgtcccatttggcataaaatttctgagcatctatcagtattcagaaatctaagccctttaggctgggcacagtggctcacacctataatcccagcactttgggaggctgaggtgggtagatcacttgaggtcaggagttcaagaccagcctggccaacaaggtgaaactctgtctgtactaaaattacaaaaattagccaggtgtggtggcacgcgcctataatcccagctactcgggaggctgaggcaggagaatcacttgaacccgggaagcagaggttgcagtgagccaggattgtgccactgcactccagcctgggtgacagagtaaaactctgtctcaaaaaaaaaaaaaaaaaaaaaagaagaagaagaaatcaaagccctttaagggcctttgatttattaatgctacattttctcatttgtacccctttaaagcatatttttaaagaaaagatgtcatcatttggtctctatttcttttctttttcaaacaggaaacagagaacactgcatacaaagttggaaatgagtcccctgtacaagaattgaaacaagatgtgtctaaaaaggttggaaagatacaatgtcaatattagtttatagcagacatcatatttatatggtatatttcaaacagcttttatattcttttagtatagcgctctgtacatggctgatgttcagcaaatgtttcatgaatctgtcacatttgtggttgaagacatttcagtctttttagaagtccttttcatattctaattggtaatttatccttgagacaatattttgtaaaatgcttttattttttgttcttgtatttttatcagaataagccctaactcttcttgaggttactaccaggagttatgggtattgaaaagctcagtgcagcaacattctgatgtctttaggaatcagaagttataagaagtccttactctgatagtacctgataccttttaaaaaattgatgctatgaagcttcaaaggttggtttactagaagagactgagcacaagatcagtattttgaaaatgggcagtttacagtatcaggataaaactcaaggagaaagacaggatggtgtgtttttattcatttatacaagttttaagtgttttctgtgccctaggcaatgttctagccagtgggtttccagaggctaacaaaatgacacattctccaccccagagtttctccagtactggcactcgacattttgggctaatagagggtaggggaaggcctgttgtgtgcattgtaagatgttttagcagtatccccagcttctacttactaaatgccaatagcatcctcaactcccaattatgacaaccaaatatatctccagatgtctgggaaggggtatggaacaaaataacccctaatggaaaaccactgttctatccttatggaatttagaaatttaatggactacattttttttttatttgaggcagggtctcactctgtcgcccaagctagagtgcagtggcacaatcatggctcactgtagcctccacctcctggactcaagtgatcctcccacctcaccctcctgagtagctgggactacaggtgtatgccaccatgcctggataatttttgtatattttatagagacaaggttttgccatgtttcccaggctggtcttgaaattctgagctcaggcaatccacccacctcagcctcccgaagtgctgggattataggtgtgcaacactgtgcccagcgagaccacatattttgatattgatcatactttttcctttaaaggaaaaatgttcccttttgggacgaatggtggattgcatagcagtgtacataacaggaattgaaccatttttttaaaaaaataagaaattgcctataattctatactataacacacaggtgtcttgatttttcagcatttccttctggtcctcatccattagcatacatttttctgcctaattgtagtgtaggtagaattttatattctgtcttttactcttaccatttttagattttcctcatacttctatatgagttctgtactcagatgcatcagattccatcaagtaaatggattacaatgttatctagccatttttattgttgaaacttaaaatattcctgttttttccactatagcttttcttattttttaaagaatgtttttcttaggataaataacaaatgtataactatctatagttagtggggaaaaaagatgattttaaggagagtttagaagtttaaacagtagtgagaaaacactgtggagcagaatgaggtttaagattctaaataatcactttttaagttctagccttttcagttgaattaagtatgaatcactaatgataaaggctatggggatataccctggacgagggcatactctgctctcgagtaacttacattttagtagaagaaattggataaacacaaaactaaatgcagtaagtattcaaataaacttagaagctattgtaagaacacaaagggaaggagacttcttgcttgggggtaggaatgaagatgacttcatggaggaggtagcatctgagctggttcttaatgaatgcataagatttggacaggctaggccgggcacggtggctcacgcctataatcccagcactttgggaggccgaggcaggcggatcacctgaggtcgggagttcgagaccagcctgaccaacatggagaaaccccatctctactaaaaatacaaaaattagctgggcgtggtggcgtgtccctgtagtcccagctacttgggaggccaaggcaggagaatcgcttgaacctggaggcagaggttgcagtgagctgaaattgcgccactgcactccagcctggtgacagagctagactccctctcaaaaaaaaaaaaaaaaaaaaggatttggccaggctaagatgggagaggaaaggcattactgaaggcatggaggtggggaatgtgcagaacatttgaggatgagcctagagagcaaagttagggctggattataggaatgccttatgtcatactaaactgtctgctttttatttatttatttatttattttttgagacttgagtctcgctctgttgcccaggctagagtgcagtggtgtgatctcagctcactgcaacctccacctcctgggttgaagcaattcttctgcctcagcctcccaagtagctgggtttacaccaacacaccaccacgccaggctaattttttatatttatttatttatttatttattttgtatttttagtagagatggggtttcaccatgttggccaggctggttttgaactcctgacctcagttgatccgcccacctcagcctcccaaagtgctgggattacaagcataagtcaccgtgtccggtcacagtgagctttttgcagcaaacaatgctttagcataatcatctctatgtgtgtcttggttctcattgttctcttagtctttccgttttcactatttcctaaaatccagaaaaaaatgacagggctaggcaccataagaaggtgtcatgaggcatatcaagaggcaaaaaacatggacctttctctccaggtactaattatctggtgtagagaaaataaatagagctagcctatatacagctctgtatttgtattatagttcatactatactgaacagtaagaataataatagaagtgcagaggagggagagattattatcagataagggattggggaagatgcattttcaacctcattttgacccctcttgtggcacagacatttccattatgtgtagtgattatttcaaacctttatactcacctcatgctcactgtacccactcacatccccctcactttcagccgataaccttgtttcctactccacgtaaatattagaggctaaaaagcctgaatccattcctttgtatcatctttcacttcctttacctacatatttattgttatttcttacctttttttcatgtcatccatcactgaagatttagtattcttgttttctgtccaaagtagtgtggtataatacaaagatcactggatttttaagtaagacctggatttcagttttggctttgtagcttactaattgtgggactggcaaaattcttaaagcctttacctcagagtcctgcttttctaggagggaggtaatccagctacctaacccaaaggcctgtatgacaattaaatgagaatgtgtatactaggtctaatacacagtaggccttctttcctttcttttccagaacattgctctgttatcttcttttccagtagttccttcccttcaggttataaaagtgctgggtcactttatcgaagtctttttgcatttatagctaagctttttgaaaactcagaccgtgctaatgtctctgtatcttcacctcttattcaatctcaaatccattgtaatatgacttctgttatcactgttatcattgaggttctcagtgctcagtaaccacctaattgacaaattggttggactctggttagttttggtgaaagcaaggtaatttctaaggttaacaatttgaagtttgagaaaaactaacatatagaacatgctaagaaatcagggatgaatattactgagcagcagtaatacccagttcaagttagcatgaaattgtagtaaaccagattaggatggttctatgatgcattctgttaactttctgaagccagggaattgagaaagcagaagttgttcatggttggacatggtggcaggataagtgatctgggagatttaatattagtaatgacaagactggggagaaaatatattctaaatgttggcagaagataatagaaagcctgtttatattttaagctacatataagaaagggggccaggcgcagtggctcatgcctgtaatcccagcactttgggaggctgaggcaggtggatcacatgaggtcgggagttaaaggccagcctggccaacatggtgaaacctcgtctctactaaaaatacaaaaattatcccggcgtggagcacctgtaatctcagcttttagggaggctgaggcaggagaattgcttgaacctgggaggcagaggttgcagtgagccaagatcgtgccactgcactccagcctgggtgacagagtgagactccatttcaaaaaagaaaaagaaaggaagggaaaagacaaggtggactgggtatttgaactcttttcatggtcctgccatcagtccacatagtggagtttaggtgtagtctgtttaagaatgttaatctccctgcatctgctggtttttgggtcataagcttgagttcagagctaaacaacttgaattcttctcctggggatttggattatcgtggtttggttaagtaggctcaaaccattaggctggtattacaacaagtttggcataaatatgtaaatgaatcaggatattgagtcttaatgtaagtttaggattgaacttgattttacaggattatttgatcttttgtacctaagtattaacacaaatttgctattatgagggttaagagtatagatgctggaatcaaactccctgggtttatacctgcttcatcacttactagctttgtgaccttggacaaatcatttgattagttccctaatttgtaaaatggtgacagtaggagtagaatctcataaggttgttgtaaagattaaaatatgtaaagtgttaagaacattgcctggcacatactaagtactatgtaaatgattagctgttactgtgttcttataaatagcttcatttttaaaaactacttttaaccctttcatcagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatggcaagtattaattgagaaatcactctgttggttgggcacagtggctcacgcctgtaatcccagcactttgggaggccaaggcgggcggatcgcttgagctcagttcaagaccagcctgggcaacatggcaaaaccccatctgagcaacaacaacaaaaaaaaatacaaaagttagctggccatggtggcacgcgcctgtagtcccagctacttgggaggctgaggcaggagagttgcttgggcctgggaggcagagactgcagtgagccaaggtcgcgccattgcactccagcctgggtgatcagagtgaaatcttgtctcaaaaaaaaaaaaaaagagagaaataactctttgtggtgaaattttggagttgaaactgtttacctttctgcctttatttcactttattaaaaaactcactggcaaccaagttattaaaattatttctttagtaatagacaaaatgtaaaaatgtttacattggtgaaaattactttactgtaattgaacacttcagcagacttcaaactttcaattctgttgccatctgagagagagtggcatggtgaaaaaaacttgggatttggagacctaaagtctgaattcaagtcctgcatcttttttttgtatgagctgtatagtcttgaggaaattaaataacttgtttgaaccatggtttccctgtataggaaatgagagtaatcaagccactttcctcacagggttgttacaagaatcaaacaaaaagggttgttattattgttgttattattatcattgcagttcccaaagagaatattacgtctgattctctcctaaccgcaagcatggcttcagaaagtacggttaaggattctcagccttctcttgatttggcaagtgctaccagtggagataaaatagttaccgcccaggttggtgaattagtgttctgtttcatatagactttatcagctccctgcaactggctggtttgttgatgattattctgtattctccaggccagatttttctttgtcctccaaacctgacccccttacttctcttgatcagctctgctacatgctaactgggtgagcctagcaagctgtttagcatctggatctcagatgccccatcaataaaatggaggaaaagtccttccttgagggtttgaaatgagctaaaatatgccaagtatctagcaggtaataggtattcaaaaaacgacagatgctactatttgtaatattgttggtactaataaacaccaactatagtctatgtttgtcctgtattggtcagaattgaagactttttttttttataatttccttttcctaatcatagaaaaactttatatgctaggaagcgggctacacaaaagacttgataacactaattttaccacagccagattctgggactcagagctacttacatggtagctgtggtgggccaggctaccacactagaatataggacactatagtcttgttatagccttagagcaggggtcagtagtggcctgctttaggaggttccccaagctaagaatgttctttacatttttaaaggttgtttaaaataagaagaagaatatgtgacagagactctatatgaacaaaaatgccttaaatatttactgtatggctctttatagagagaagttttctgacccctacctttgaggtagccacatacagtccagattaatagcagtcttagtagagaaatgccttttggccaggttcaaatagaacatttatttgttttcaagaatactaagacattatttcatgagcagcaatagttttggttcctaatgtttttcagcatgctgggaaaaatgaaggactgaaacgtaatgttccatttagattttcagcagactccattatctgaattatgaaattctttagaattatatgtggtaataattgaaaatttatagaaattgattcagtctaatttctgtttataaaattatatttccaggaaaatggaaaagcacctgatgggcagactgtagcaggtgaagtgatgggccctcagagacctagatccaactctgggagagagcttactgatgaggtagaaatagatttttttgttcttgttcttaaaacataaagtacaaaaaacataatgggaagatgaaaacgttctggagatggatggtaatgatggttgcatgacaatgtgaatgtacttaatgacccagaactatacacttaaaaatggttaaaatggtaaattttatgttatgtgtagtttaccacaatttaattttttttaagtttattgctgttacacacaaaaaaaaatacagaagaaaaaatgaaaattgaagattgtctttgttgatatgctggatgtagcatctctgacttaaacttgccctttcactgtgttgcatagtggaataaatatattgaaagcaaggtttatattttatagaaagtgggctttaaaagaacttgatattgaggccaggtgtggtggctcactcctgtaatcccagcactttgggaggccaaggtgggcaggtcacttgaggtcaggagtttgagaccagcctggccaacatggcaaaaccctgtctctactaaaaatacaaaaattagccaggcatggtggtgtgcatctgtaatcccagttacccagaggctgaggcaggagaatcacttgaacctgggaggcggaggttgcagtgagccgagatcacaccactgcactccaacctgggcgacagagcaagactcggtctcaagaaaaaaaatttaaaataatataataataaaagaacttgatattatgaatatatgttataccaaaataaatttttttattattttaatggtttcttatcattaaaacttagtatgcacctattagccaacttattcagaattaaattttacagcaaaatcttagttgatgtttctttaaaacaatacatttcttaaaatattgcactttggaaaacagtttggcaattcctcaaaatgtgaaacatagtgttaccatgacccagcaattccgttcctttgtatataccaatgagaaatgaaaacatatgttcacacaaaaaaatgtacacaaatattcacagcatcatcattcataacagccagaaagtggaaacaacccaaatgttcatcactgattggatggataaataaaatgtggtatattcataccatgttatattttttagcaattaaaaggaatgaagggataaagtactgatacatgctacaacatggataaaccttgaaaacatcatgttaagttaaagaaaccgacataaaacgccatatattacaggatttgatttatatgaaatgtatggaataggcaaatctatagagacagaaagtagattggtatttgccaggggctaaaaagaaagggaaatgaggtgtgactgctaatgggtagggaatttccttttggggtgcagaaaatattctgacttagtggcaatagttgtacaactctgtgaatatactaaaaaccattgaattatatgctttaaatgagtgcattttgtggcatgtgaattatatctcaataaaaatgttagaaattattgtgtgcagtattgaatatatctaaaaagcctttagcttaaattttaggggattttgtagactcaaaaagataattaaattgcaggtcatcttggtgtgattgttttttttttttaacctcaggaaattttagccagtgtaatgattaagaacctggatactggagaagaaatacctttgagtcttgcagaagagaaactaccaacaggcattaatcctctcactctacacatcatgagaaggacaaaagaatatgtaaggtatggcctaatgttgttatttgtcatttctagtatttcagagttgttaagatttctctgttaatgaactatgacaacccctaatttggtttcattcagtcttttttcttctggaattaaaatagagttagataatgtatgtattctttaactttgctcttcattatgactgtacagttacttggggaaaatagtataaatattaaatcccatagcacttaatttctcttttttaatgatttaaattatacttgagacaatataaaaacagtgaggcagccaggcgtgatagttcatgcctgtaatcccagcactttaggaggctgaggcagcacttgaattcaggagttagagaggagcctgggcaacatagtgagacctcatctccacaaaaataaataaataaattaaaataacagaaaaatgaggctaaaaagctatgtagaatgaacacttagtcttctgaaaccttgctttaaggatcataaattgtttaaatatttgtactgtttttgtaggatcagaaaatggctttaaaatgagatgagtgactttactacgagatgtatgtggatctattgaatcattttggtaaaagcaggagctattttattaaatgtaatgcaggatgtacttaatgagtggggaggaagatacctacaagttactttattatttccctatagcacattttgccaagcaaaaaggtttgtttgtagtaggtttttcataaatttctaaattgcattcatttacatgttgtacattgaaccttgcttaaagattcttttcttcaatttctgaagcctttaagttgtcaggtccatcatttaaattaaaattatatgggccgagcacagtggctcacacccgtaattctagcactttaggaggccaaggtgggtggattgcctgagctcaggagttcgacacgagcctgggcaacatggtgaaaccctgtctctactaaaatacaaaaaattagccagacatggtggtgtgcgcctatagtcccaagtactcaggaggctgaggcaggagaattgcttgaaccagggaggcggaggttgcagtgagccaagattgtgccactgcactgcagcttgggcgacagagcaagactccatctcctaaataaataaataaataattaaaattatgtaaagcttattagcgtagtttttcttattctgattaactggttatatagtaagtataaacagatttttaagaagtatagaagaaatggcttcttttaaaacaacttccccttcttacagtaatgacgcggcacagtcagatgatgaagagaagttacagtctcagccaacagatactgatggtggaaggttaaaacagaaaacgtgagttacagtacatcccttttcttcatttcaagtttttatttaaaaaaatatgagaactaccatactattttaaatcatgctccatgtagtttttatgtctacccaccaccattcctccctgtccctcgctgatgggttatgaagttgtattgattagttttaaagcatctgggctgggcgcaatggctcacgcctataatcccatcactttgggaggccaaggcaggcagatctcctgagatcaggggttcaagaccagcctggccaacatggtgaaaccccatctctactaaaaatacaaaaattagttgggcatgatgacaggtgcctgtaatcccagctacttgggaggctgaggcaggagaatcacttgaacccaggaggtggactccactgcactccagcctgggcgacagagcaagactccccctcaaaaaaaaaatggtaataataataaagcatctgacatacagaaaatgaccagtaagtgttgcaccatacttgtgttatttttctaccagtaggtaggtacgaaaagtgttagtagaagaacatgattgtccttgaagttgtcttttccctttctctttatctctgcaatcctatttgtctttctaaacccaactataatgagattcctcctgactactacagtccatggcaattttctttcttttctcaattttgggaatacctgtagtctataacttactttttccctttacaatatgttatcttaaactgttttcagacaaatacacattaaacaatcaaagcgtatgttgcaaaaggattctgattatgccatcctttgtttcccctacaaacttctagatcaatggtgggcctgtacattttgtttgattatacacaagtcactaaattgataataattaactctaaggtccaaagtgaattatccacttgagtccttttcctagtgtgtatcaaagaaagcattgagaatttttaggaaagatgtacctaaaatgcaggcatatgatagcaccttagatatttggaacttggccatctagtagttgcagttattgggaacctgagaataaggaattactacaattattctgggacagataaacatccagaagagatgtcacatagtccatgcactaaagctcattatttttctaagagaaaagttcctcaggtttattcaaagccattatgcttatttcttacatcattttttttaaaactctgttcagtgtctgagcttactgcaaaatagaagcagcaaactgtgacaacatgtaagttgacacataagaatgtcaggtaatcagaaaaatgataaaataactcataatataggtgggtgcagtggctcacacctgtaatcctagcattttgggagaccaaagtaggaggatcacttgagcccaggagtttgagagcagcctgagcaacacaggtagactcactctttaccaaaaaattttaaaaattagccaggcatggtggcacacacatgtggtctcagctactcaggaggctgacatgggagaattgcttgagcctgagggatcgaggctgcagtgagccgtgatcacaccactgcacttcggcctgggtgacagagcaagaccttgtcccccacaccccccaccaaaaaaaaaaaactcatagcacaatcattgtaccacagtgcttttcaaccttttcttatgccattgacacacagagaacataatagtatttgcactgaatgttggggtaagctggccatcagctgatggccagagaagattggcccaggcttccctgggccctgccctgttgccttgaaggctgagtggggaaccaatagtatggcccacctgcaatgcattagaaaggctctgaatgtattaaagaaccaaaatgatggtaacgatcttatccatcaaggaatgaaatttagggaacattaagtgccatttaagaaggcataaaagtagatactttagaactattaccatctgaaataattaaaatgtctgttttcttggcttttaaagtggtagtaaacttataattatccagaaaatacagcttcagagttataggtagcagagaccttataatggctttaaaaatggtttatcatctgtgttttctggttatcaaaagaaatacagaaatatgtaaaatagaaaatgaaagtttctcataatctcagccccagaaatcagttttgtttttttttttattatactttaagttttagggtacatgtgcacattgtgcaggttagttacacatgtatacatgtgccatgctggtgcgctgcacccactaactcgtcatctagcattaggtatatctcccaatgctatccctccccactccccccaccccaccacagtccccagagtgtgatattccccttcctgagtccatgtgatctcattgttcaattcccacctatgagtgagaatatgtggtgtttggttttttgttcttgcgatagtttactgagaatgatgatttccaatttcatccatgtccctacaaaggacatgaactcatcattttgtatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagtccattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataagatgtaaggaagggatccagtttcagctttctacatatggctagccaatccagaaatcagttttaatagcatggtgtattcgccatagaatttttttttctcgtaaaagcggggctactctatgtctatagtttgtcaacttgctgttttttgttttttttgtttttttggtttttttttagaaaatcaaatatatcatagacatctctttatatcagcactaataatatatatattgtagtctttctgagagccagatatgagagttaagtgcttgggatataacagttaagacattaagaggccaggcgtggtggctcatgcctgtaatccagcactttgggaggccgaggcaggtggattacctgaggtcaggagttcacgaccagcccggccaacatggtgaaagcccatctctactaaaaatacaaaaaattagctgggcatggtggtgggcgcctgtactcctagctactcgggaggctgaagcaggagaattgcttgaacccaggaggcagagattgcagtgagctgagatcatgcctttgcactccagcctgggcatcaagagtgaaactctgtctcaaaaaaaaaaaaaaaaaaaaaaaacattcaggatgggtgcaatggctcatgcttgtaatccgagcactttgggaggccaaggcaggtggatcacttgagtccaggagttcaagaccagcctgggcaacatggcaggaccccgtctctacaaaaaatacaaaaattagccaggcatggtggtgtgtgcctgtaatcccagcaactcagaaggcagaggcaggtgggtctattgatcctgggatgtcaaggctgcagtgagccaaaatcatgccactgcactccagtctgggcaacagagcaagactctgtctcaattaaaaacaatttataaaaaagacattcgtggtctctgccttcatagaacttctgttaaatgggagaaataggcattaaacatgtaattgcacagataagtctagctacatttgtagtgattgctataaaagaaaagttccaggtgctgtggagatattacagtagttccctcttatccatggggtatacgttccaagatccccagtggatacctgaaatcacagatagtaccagactctgtatctactgtgttttttctatctgataaccaagaagactactaagtaataagtgggtatcatctatagcgtggaaacactggacagagggatgattcacatcccaggtaggatggagcagggtggtgtgagatttcatcatgctactcagaatggcacacgatttaaaacttacaaattgttttatttctgggattttccatttaatatttttggaccatggttgactggggtaactgaaaccatgtaaagtcaaacttgggataaacggggactatgtaacaaaaactctgtctaaagttaaaaaggccattttgagagagctgtttgatctgagacctaaaaagtgagtgggaattagccaagggagaggtgttccaggcagaaataaccacacatgcaaagcccctgaggttactataagagcttggcacatttaaaaagctgaggtttgcctcattaattttattgtatttcataccagcacttatttatctgttcctctattgacaaaaaaaaatttagtttatttccactttttgactattctaaacagtgttacattgaacttctctgtatatataacttaacaacttttaaaaatactgtccctcatgagctcccatgaatcagtaaaaatttactcctgatttgtatttcttttggttttaaatatcatcatgtactgtgcattgctttttgtaatcttaatatatgaaatctgagacttagctaattgaaaatgcaataagtaagtcctatttatggaagcttgagatgcatacttagtttacctcgtatttgggaatacctactaggaaaactcagcctaattttattacatgcacctacccaaactgaaagagaagggacaagggaccatcttaagctaccaaagcattctattttgtgaggaaatatctctttactctttattggtaaaatgtgtttttaagaacagctctctaaagcagccttctcaaagcagttctcacccccagactctctaaattggattatctggggatggagctgaagtacctacactttaaacactcccctctccacactacctctgccaatcaatttttattcaccattgaaaaccaaagctctagaatatatgaatattgtaaattgggggaaagggtgtatgtttcctttgccatattgacttgaatatgtttattccatagaataagggatttggaactcaaacacctattatttatgtttaaaaaagttatttcaaagtagtgtactttatcagtcacagctgatacatttgtctgcaaattattggacttttacagttaactgagttgatacttttttcatttttgttaaggactcaactaaagaagtttcttggaaaatcagtaaagagagcaaagcaccttgctgaggaatatggtgaacgtgctataaataaagttaaaagtgttagagatgaaggtgagttaaaacagaacatttcaactaaacattcaattaatttgtaatcgtctaaatttagcctgtagtttgtaagaagcattctatttaaaatagtaaacctttatagctgacatcttagtatttcaataaataaggtactctatgacttaattttatgagtgtgaagaaaaatggatttatacatattttgtgacttttgacagtctgaaatggttgagtgttaaataatcagttatgaattagtttcgtttgtttgtttgtttgtttatttgagatggagtcttactctgttgcccaggctggagtgcagtggcgcgatctcggctcactgcaagctccacctcccaggttcacaccattctcctgcctcagcctcccgagtagctgggactacaggcgcctgccaccacacctggctaattttttgtgtttttagtagagacggggtttcactgtgttagccaggatggtctcgatctcctgacctcgtgatctgcctgcctcggactcccaaagtgctgggattacaggcgtgagccactgcacccggccataaattagttttttaaggctatttggttttgggtttttcttttttctttttttttgagaaagtcttgctctgtcgcccagactggggtggaatggcatgatcttggctcactgcaacctccgtctcctgggttcaagccattctcctgcctcagcttaccaagtagctgggattataggcacacaccaccacacctggctaatttttgtatttttagcagagacagggttttgccatgttggccaggctggtattgaactcctgacctcaggtgatccacccacttctacctcccaaaatgctggaattacaggcatgagccaccacgtctggccaaggctatttttttcttttttggagatggagtctcgctctgtcacccaggctggagtacagtggcacgatctcggctcacttcaacctctgcctcctgggttcaaacaattctcctgcctcagcctcccaagtagctgggattacaggcacctgccaccacacctggctaatttttgtatttttagtagggacagggtttcaccatgttgcccaagctggtctcgcactgatgacctcaggtgatctgcccacctcagcctctcaaagctctgggattacaagcgtgagccaccgcgcctggccagctatttggtttttacaaatacagtcagtcctccatatccatgggttccacatggagggattcaaacaaccacagatagaaaaatatttttaaaaatatataaaaaataacaatgcaacaataaaacataatagaaaaaataatataacaactatttatataacatttacactgcagtagatattataagtaatctagagattatttaaagtatacagggcgaggcatggtggctcatgcctataattccagtactttgagaggccaagacaggagaaccgcttgaggccaggagttcgagactagcctggtcaaacatagtgagaccctgtctctactaaaaaataaaaattagctttgtgtagtgacgtgtgcctatagtcccagctactcagaaggccaaggagcaggattgcttgagcccaagagttcagggctgcaatgagctatgattgcaccattgcactccaacctgagaccctgtctttaaaaaagaaagcaagtacgtgaaaggatgtgcataggttatatgcaaataccatgccattttatgttaagggatttgagcattcgcagattttggtacccatagcaggtcctgccatggatactggggaataactgtattttcaaaattaggtagggctgggtatgatggctcatatctgtaatcccaacactttggaaggctaaggcaggaggatcacttaagcccaggagttggagaccagcttgggcaacatagtgagacccctgtttgtataaaaataaataaataaatttttttaattaggtaaattttctaaatttgcacatatcttaacctcctatgcttttgtcattattgtactcatttgttttatttaatgaaacttacatagtacttattcagtgcctgggactgtactaagcacttttacctgtattaattcatttaatcccatagaaaccctatgaggtaagtaccatcattatccccatttgatagatgagaaaactaagaggcatcgaaagttgagtaacttgcctgtggtcacacagataataaatgacagagctggatttgaacctggcagtctggcattagactccatgtttttaaccagtatgttatataataaataaattttgctcttccatttaatgaattttcttggtatgcaggaaatatgaaattatgataatagcaatatctacattagctagtagtgatttctgttgcttttctgttcagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatggtaagcaactttttcattttttaggattgatactgtttttgttaagagaaatactttggcttctacaaaactatctctttctatgtatgtaactttgctagcctgactcaagaacggggaatttatgttaacatgatttaatgaataggtaatgcaaagtctatctctgaattattccagaagtgacttatcggccaggtgcggtggctcacgcctgtaatcccagcactttgggaggccaagacaggcggatcacttgaggtcaggagttcgagaccagcctgaccaacatggcgaaaccctgtctctacgaaaaatataaaaattagccaagcatggtggcgggtgcctgtaatcccagctacttgggaggctgaggcaggagaattgcttgaacccaggaggcagaggttgtggtgagtcgagtttgtgccactgcactccagcctgggctacagagtaaaaaactccgtctcaaaaaaaaaaaaaaaagaaagaaaggagttattgaataagtaaactctcaggctgtatcactaagaaagctatgcaaaggcaccaaactttaaagcagttagattagagggtgtaactttgaaaaatgtttaaaatgctcccaaccatattttaaataatttacaaaatatatcagaagctcaatatatgttgtaaagtgagatattcagctaaaacaaggagagaggtaaaagttcaagttctcctttagagttcaaatgtaccaatgtagatgcaattgcacaaactgtattgtggttaacccctgaaaatgctaggaacacaaagaaggcagtgataaaatttagatctgaataaataatactgtgcccttgatcagggaatctgtttacattttaagtctaaaagttggcttaactagaatgaagcaaccataaatatattggatggcaaccaaattcaaatttaaattttgatgtttacagataaatgtttgagttgattttagtattttccttaaggaaattgatgaatttcctagtactgtattgactcgttatttcctgttttaaataaaatctcatcgtagtaggctccaaatgactcatttttaatacacttgaattttgtagaagtgaatggttatttcaataaatgggctgtggcataatctttttgatacatctgaatgtgtatataatagtatttcttgtaataagatttggtctttccaacttaagaggttcatgttctttctccctgctcctccacccccaccacacacacatactttcctattgttctcagtatctagagattctggtcatatactttgaaaccttgtttctagagagaaaagtaggatgagaccacaccactccaatacaactacctttttttttttttctttttgtggcagagtctcgctctgtcacccaggctggagtgcaggggcgggatctcagctcactgaagcctctgcctcctgggctcaagcagtcctccctcctcagcctcctgagtagctgggaccacaggtgcgcaccaccatgcctggctaattttttgtattttttgtagagatggggtttcgccatgttgcccaggctagtctcaaactcctgagctcaagtgatccacccgcctggacctcccaaagtgctgggattacaggcgcgtgccaccacgcccggcccattccaaaactgtaatacttctaagtgctggatgctatacgggtcactgccaaggtgggctttagtcttcctcagtcctgctcagttgttagtgctatgctgagggctctgccacccatctttacgttcagctaggggactaagatccccagctaggatttgtgcttttccaatgaagatttctgaccactttagaactcccatttctgttaatatgtggacagggtttgagttcttgaagttgttagtttagattatggaacactacaactatcttaccctacctttcttgtgaaagtctacttttgtggtattatagcaccattgaacttttggacttaagtagtgttagcaatttgagcattatcttagtatatgtaatttggcgtaattttaaactttggctttaaagtaatgtctctattttattttatttattattatttttagatagagtttcgcttttgttgcccaggctggagtgcaatggcgcggtcttgactcactgcacccttcacctcccaggttcaagtgatcctcctgcctcagcctcctaagtggctgggattacaggcgcccgccaccatgcccagctaatttttgtatttttagcagagatggggttttaccatgttggccaggctggtctcgaactcctgaccttaggtgatccacctgcctcagcctcccaaagtgctgagattacagacgtgagccaccatgccaggccaaaagtaaagtctctaaaggtgtaaagtattaactttgaaacttcttttgttttcatagggagctgtttggaccatgaaattttctcactgtggccgattacttgcctcagctggacaagacaatgtagtgagaatatgggctttaaaaaatgcttttgactatttcaacaatatgcgaatgaaatacaatactgaaggtatttttcatctatttaaaaatctacagaaacctgaagtttttacattttaggtatactgatgccctacttttctggcagtcatttgcagcaaccactacttatgataatagccaaaaacttgaaagtaagacagacgtcagtggcaaaaagtctctaaacccaatgaaaagagctgccacaaagcttttgatttattcctttccaggtgtagtgtgtagttaatttcatcaactattgagaacatgatatttggtttcctctggcaaccttcagttctatcctaggttaaaatagaattgctaattaaactggaaaaagaatgaaaatcatatatatccagtaagtaaaaatgattaaggaaaaagtcatggaaaatgaatgtgaattgtcaatatatcaagggatatatgaaaaaatgttgaaaagagaagcctcagaacattatgtacacactgattacaactatgtacagatatttatgtatcatggtgttatcaggaaagtatgtagaactgatgtaaatttgggctttaagttcatgggattcttttctaataactatttaactgtgtaataagttttttccacaccctccccgccatcaagtaaggctgcaaacgagaagtaaagcataggagaaaggagaagaaaggtggccatgggtgagagtatatagtcaaagcaccaatttgaggaacataaaagtctagggagattcactaaactggcaagctagacctcatatacttgagtaaatcctgtgagtattgcttgcattatgtttcagtacttagttgaagatgataataatttgacaagaagttaaactgtgtttactatatggtgagtttttctagtcctagctgtgtgtcatttcttttactgccctgccaagagcaaaaagactattttcagtggcccttgagactaaccccagccctgaacctttctgctcctttattgttcctcttgctacttgtcatgattaataagaatgtgttctattcgaatactgaggatttaacggtattttgtttactaaagtagggaaatggttaagccattttatgaagtttttatgtaaaaatgattgaaacaaatattttggctcctatagggttatgcctcaattgttagtatttttctagaatactgtattctctaactattagacattgctgtgtcattacttctggatgttatattttggtgggtctgtgtgtgtacatacatgccttttttacaattattatgttgtttttaggacgtgtgtccccatcaccctctcaggaaagtctaagttcatcaaaatcggatacagatacaggggtatgcttattgttttatggttactctgttttcaggtatgatttaatttgtttaccataaagtatttttgtgtatcagaaattacagttgcatgaagacacttaatataaaattaagatgtatcattagaaccaagagtttcttcaattagaagaaattagcaaatgaaaatttttgatatttaaaggttgccagacagtgaatactattgctcagggtactataccactaatgtaaacttaaataatacaaaagcccctcccctcaaatccatgttagacatttttaaaataatgataatagatacccaaataagaggtaattaaggaaagaaaaaatatatttaagtattttaattttctaatcttcttggtttaataaacactttatcacagtttcagataaggtatcttaatgattttcatttggttttagagctggaaggttaaatataaccaattttaaacctataaagcagaatacacaatattgtactaagttgtcacctgtgttttttgtgtgttgcattaggtaagggtgatataaacaagagaacctaaaatgtctacctgctcaacagtattttcctgagatttcattggctccagtatttgacactacgttttctccttctcctggctttccatggttctgtttccctttgttctcttatactcccactgtttcttcttccatctccttacatttactgtttctcagggtctgttcttggccattttcaatagacatatttatgctcttcttctagtcctgaactggctttagatctgtaattctttgtttactttcagtaactttatgatttttaaacaagaacattattgtgcttgctgccttttcacataatatataggatctctttatctacatgtaatccaaccacatcaactaataggtccaaaactaaactccttcaacaaatgttttctgagtgcctgctatatgtggcagacactgctacatgctataaaatcaaatgagacatattctctgtcctcagggatcttgtgaactagtgaaatgggtaaactcacaattacagtattagatggtgatattctacagaaggtactacacaaaaataggttagccttataaatcacagtgttaggaatagtttcctggaaacttgttatttgagctaggatttagctatatgagagaagaaaggaaggagcgtgtcagacccagggactagcaagtgcaaaagcatggaggctagtatgttaaaggtactacaaggaattacacatggctgggaaaggtgcatttgtgagattggtgggagaggtaggcaggagtggaattttaaatgactttttgtgatgaaccaagatggaactttatcctgcaaactactgggagcagggtggggctttgaaggatttcactcagaggcataattaccatgttcagatttttgttttagaaagagtattctggtagtattgtgaaggatagactaggtgggggcttcaggtttgagacagggagaccatgtaagaggctattaacccagagaaatggttacttccgattttgatgattatgataccagtagagctagaaactgtaaagataagctgaattgagagatgtaaaataagtctaatttgtaggacttggtgactgactagctggggtagtaaaagtgagtagcctgggatgaatcacaggtgtctagcttgcgtagttagctacatggtaatggtcactcatagaaatattttttatattttaatttttccataagttattggggtacaggtggtatttggttacataagttctttagtgattttggtgcacccatcacccaaggagtatacactgcacctatttgtagtcttttattcctcaccctcctcccactcttcctcccaagtccccaaagtccattgtatcattcttacatctttgcgtcctcatagtttagctcccacatatcagtgagaacatacaatgtttggttttccattcctgagttacttctcttagaataatagtctccaatctcatccaggttgctgcaaatgctgttaattcattcctttttatggctgagtagtattccatcgtgtatacataccagtttctttatccactcgttgattgatgggcatttgggttggttccacgtttttgcaattccaaattgtgctgctataaacgtgcgtgtgcaagtatctttttctaataatgacttcttttcctctgggtagatacccaatagtgggattgatggatcaaatgttagttctacttttatttctttaaggaatctccacgctgttttccacagtggttgtattagtttacattcccactagcagtgtagaagtgttccctgatcaccacatccacgccaacatctattttttgattttttattatggccattcttgcaggagtaagatggtatcacatcgaggttttgatttacatttccctgattattgtgatgttgagcattttttcatacgtgtgttggccatttgtatatttttttgagaattgtctatttatgtccttagcccactttttgatggactgtttttttcttactgatttgtttgagtttgttgttcattctggatattagttagtccttagttggatgtatagattgtgaagattttctcccactctgtgggttgtctgtttactctgctgactgttccttttgctgtgcaaaagctcgttagtgtaattaagtcccaactatttatttttattgcatttgcttttgggttcctggtcatgaaatccttgcctaagccaatgtctagaagggtttttccaatgttatcttctagaatttttatgctttcaggtcttagattcgagtccttaatccctcttgagttgatttttgtataaagtgagagatgaggatccagtttcattatcctacacgtggctagccagttatctcagcaccatttgttgaaaagggtgtcctttccccactttttatgtttttgtttgctttgtcaaagatcagttggctgtaaatatttgggtttatttctgggttctctattgttttccattggtctgtgtgcctatgtttataccagtaccatactgtcttggtgactatggccttatagtttgaaatcagtaagtgtgacgcctccgtatttgttcttttgcttagtcttgctttggctgtgtgggctcttttggttccatatgaattttagaattgttttttctaattctgtgaagaatgatggtggtattttgatggggattgcgttgaacttgcgattgctttttttttttttttttttatgttccatggttttgtgtttttttttttccattactggatatatacccaaaggactataaatcatgctgctataaagacacatgcacacgtatgtttattgtggcactattcacaatagcaaagtcttggaaccaacccaaatgtccaacaataatagactggattaagaaaatgtggcagattgctttttgaagtatggccattttcacaatattgattctacccatccatgagcatgggatgtgtttccatttgtttgtgtcgtccatgatttctttcagcagcgttttgtagttttccttgtagatgtctttcgcctctttggttaggtatattcctaagtattttatttttttgcagcttttgtaaaagtgattgagttatcgatttgattcttcgcttggttgctgttggtgtatacaagagctactgatttgtttacattaatcttgtatctggaaactgtgctgaattcttttatcagttctgagctttctggaggagtctttagggtttccgaggtaaatgatcatatcgtcagcaaacagtgacagtttgactttctctttaccccatttgaatgccctttatttctttctcttgtctgattgctctggctaggacttccagtactgtgttgaagaggagtggtaagagtgggcatccttgtcttgttccagttctcagagggaatgctttcaatttttccccattcagtattatgttggctgtgggtttgtcatagatggcttttattacactgagatatgtcacctgtatgctgattttgctgagagttttaatcataaaggatgctggattttgtcaaatgctttttctgcatctattgagatgatcatgtgatttttgtttttaattctgtttatgtggtgtatcacatttattgacttgcatatgttaaaccatccctgcatccctgctatgaaacccacttgaactgggtggattatcttttcgatatgttgttggatttggttagctagtatgttgttaaggattttagcatctatgttcatcagggatattggtctgtagttttcttttttggttgtgtcctttcctgattttggtattagtgggtgatgctggcttcatagaatgaattagggaggattccctctttttctatcttgtggaatagtgtcaaaagaattgttaccaattcttctttgaatgtctggtagaattctgctgtgaatccatctggtcctggactttttttgagatggagtctcactctgttgcccaggctggagtgcagtggcgcaatctcagctcactgcagcctccgcctcctgggttccaacgattctcctgcctcagccttcctggtagctgggattacaggcacacaccaccatgcccggctagtttttgtatttttagtagagacgaggtttcaacatgttggccaggctagtcttgaactcctggcctcaggtgatccgcctgcctcggcctcccaaagtgctgggattacaggcatgagccatcgtgcccagccagtcctggactgttttttttgttgataatttttaaattaccatttcaatctcgctgcttgttattggtctgttcagggtatctatttcttcctaatttaagctaggagggttgtatttttccaggaatttttccatctcttctaggttttctagtttatgtgcataaaggtgttcatagtagccttgaatgatcttttgtatttcagtgatgtcagttgtaatatctcctgtttctcttcttaatgaggttatttggattttctcttttattttcttggttaatcttgctaacagtctatcaattttatttatcttttcaaagaaccagctttgtgtttcatttatcttttgtattttttgtttgtttcaatttagtttaattctgctctgatcttggtaatttcctttcttctgctggctttgggtttggtttgttcttgtttctctagttccttgaagtgtgaccttagcatgtcagtttgtgctctttgagtctttttgatgtaggcatttatagggctatgaactttcctgttagcaccacctttgctgtatcccaaaggttatgatagattgtttcattattgtcattcagttcaaataattttttaatttccatcttgatttcatttttgaccgagtgctcattcaggagcaggttattttatttccatgtatttgcacggtttcgaaggttccttttggagttcatttccagttttattccactgtagtctgagagagtgcttgatataatttcaattttcttaaatttattgaggctcgttttatggcctatcatatggtctatcttggagaaggttccatgcgctattgaatagaatgtgtattctgcagttgttggatggaatgttctgtatatatatctgttaagtccatttgttccaaggtatagtttaaattcgttgtttctttgttgactttctgccttgatgacctgtctagtgctgtcagtggagtattgaagtccccaactattatcgtgttgccgtctatctcatttcttaggtctattagtaattgttttataaatttgggagctccagtcttaggtgcataaatgtttaggattgtgatattttcctgttggacaaggccttttactgttatatcatgtccctctttgtctcttttaaatgctgttgctttaaagtttgttttgtctgatataagaatagctacccctgttcgcttttggtgtccatttgcatgaaacgccttttaccacccctttaagtttatttgagtccttatgtctcctgaagacagcagatagttggttggtgggttcttatccattctgcatctctgtatcttttaactggagcatttaggccacttacattcaatgttagtattgagatgtgagatacctcatagtgttatttgttgcctgtgtaccttggttttttttgtttttgctttttaacttacatttttgttttataggttctgtatgatttatgctttaaagaagttctgttttaatgtgtttccaggatttgtttcaagatttagagctcgttttagcagttcttatagtggtggcttagtagtggcaaattctctcagcatttgtttgtctgaaaacgactgtatctttccttcatatatgatacttagttttactggatacaaaattcttagtgataattgttttgtttgaggaggctgaagatagggccccaatcccttctagcttgtagggtttctgctgagaaatccgctgctaatctgttaggttttcctttatacgttacctggtgcttttgtctcacagctcttaagattctttcctttgtcttaactttagataacgtgatgacagtgtgcctacgcgatgatcattttgtgatgaatttcccacttgttctttgtgcttcttgtatttgaatgtctagatctcgagcaaggccggggaagttttccttgattattcccccaaatatgtttttcaaactttcagacatctcttcttcctcaggaacatcagttattcttaggtttggtgtttaacataatcccagacctcgtagaggcttcattcatattctcttattcttttttctttgtctttgttgtattgggttaatttgaagaccttgtctttgagctctgaatttctttcttctacttgttcaattctattgctgagactttccagagcatttttcatttctataagtgtgtacagtgtttcctgaagtttttattgttttttttctttatgctatccatttccttgaatatttctcccttcacttcttgtatcgttttttggatttcactgcattgggctttgcctttctctggcgcctcccagattaacttaataactaacctcctgaattctttttcaggtaaatcagggatttcttattggtttggatgcattgctgatgaactagtgtgatttttcgggggttgttaaagagccttgttttgtcaaattaccagagttggttttctggttccttctcatttgggtaggctctgtcagagtctagggctgaaggctgttgttcagattcgtttgtcccactgggtgttcccttgatgtagtactcttccctttttcctatggatgtggcttcctgtgagccgagctgcagggattgttatctctcttctgggtctagccacccagcaagtctacccagctctgagctggtactggaggttgtctgcagagagtcctgtgatgtgaaccgtctatgggtctctcagccgtggataccagcacctgtaccagtggaagtggcaggggggtgaaatggactctgtgagggttcttagctttggtggtttaattttctatttttgtgctggttggccttctgctgggaggtggcgctttccaaagagcatcaagctatggtagtatggattggaaatggtggtgggtggggccctagaactctcaagagtatatgccctttgtcttcagctaccagggtggataaggaaggcccatcaggtgggggcagggctaggtgtgtctgagctcagaatctccttggttgggtcttgctgaggctgctgtgggggatggatgtgatgttcccaggtcaatgaagttgcgtacctaggaagattatggctgcctctgctgagtcatgcaggttgtcagggaagcgggggaaagctggcagtcacaggcctcacccagctcccacacaaacggaagggccagtctcactcccaccatgccccctcaacagccccaagtctgtttccaggcagtaggggatctgggcctgagaacttgccccaggctactcacctcccagctgtgaaagaaaaaggcttggttctttccccacctatggagtctgcacaccggattcgtgccctcccccttctggccaggaggcttctcgccagttcaaattgttacaaagttcagctggagacttccttctccctatagtgtttcccctcctattcctctggctgccctcccgaaggatccctgtggtgccaggcaggaatggcctgcttgaagacccagcgagctcccaaggctttcctgctgcttcctctacttctatatttcgctgggctctctaaattgactcagctccaggtaaggtcagaaacttatcctgcaaacagacgttcagtttccccagtgggggtgtgtgttccggagaggaggatctccctttcccacttctgcagtttgggcactcacagtattcggggtgtctcctgggtcctgcaggagcattctgcttccttcagagggtctgtgggttctcttgggattcctagttctttcttgcagtcgatctgcagctaaaattcatggtgtgagcctccgcatgctgctctgtccatctgagtaggagctgcaatctagtcctgcctcctgtctgccatgatggcatcccattatgtttaaaatgtttcttatagatagcatatagttagaccatgtttttttacccactctgccagtttctgttttttaattggtacatttataccatttaaacttactgtaattattgctactttaaactcaaatctgtcatctttatgatcattcattgaaatattttcatcattcacccacaaacctgcttctcctcacttctgaaccttatttagtggcatcaacatctacacgttacctttttaactcaatcaaaaatactccattactttttcttccttacccacatttcaaattagtaacaaattcctagccactctacccccacccacaaatacctgtggaacttaccccctcatccctaattgtcacacacatcgtctaggtcttcaacactcatttaaatgcttgccatagtctcctaattgttttttctgcctctggtctctacccaattcattttctacactgccaccagccagccaggtttttcaaaacagattgactgtgccattgtgtggtttaaaatttttttttcttttttttgagacagagtctcgctctgtcgccgaggctggagtgcagtggcatgatctcggctcatttgcaacctgcgcctcccgggttcaaggggttctcctgcctcagcctcccaaataactggtattacaggcactcaccaccatgcccagctaatttttgtgtttttagtagagatagggtttcaccatgttggccaggctggtcttaaactcctgacctcaagtgatcctcccacctcggccccccaaagtgctgggattacaggcgtgagccaccatgcccagccttgcggtttaaaatcttttgacggccctttatctcccccacaataagattcttccctgtattgcctaatcttaacttttgactcagttccaattccctagtgcctgtgcatcctaccagccgtgcctgatacaggtctgtacactataaacactttcactttcatgtctctgtccctgctgtttgctttgccttcacagggcaaagccctacttatccttcaagattcagctcaaatatcttattattttccctgaatccagcagataaaattgttcttcatttgtattctaatagtacatcataggtacttttatactgatattaccatgtctttcttgttagtctccctggctaggctctgggctgattgaaggcaaagaactgtacttcacagattttagtatccttggaatctaattccattcctgactgtagcaggcccataatcatgttgaattcctgcctgtggaccttattcctattgttccccttatttggatgccttgatcatctttctattcaaagcatgcccattcttcatggcccgcttcctccataaagcctcactgactaatgtagcagagataattttaactgctttgctttagggaaaagggcttgcttttattagtttaatttaccatacagtttccaggcattgattactattaaaaatagagactatctgtagtatcttttattgcgcttatttcagcaatcctacttatagatcctcagctacatccatctaaccccaaacagacctaagtaactcacaattttattgaatacaaagcctttttacatgagaaataacatttatatccattgttttcaggaagagatcatttggggtttgtttcccttctgtcattttatttggggacagttaaaagaggcttctatttcacatgccattagagtttgacaccagaaattatcttctaacctagtgctagccacagtgaggcacagtaaacacaatggagtttatgttcctgatgtgtgtattctttttttcttatgatagtgatatctttttcatctcttttgaagtactttttcagtcttttgtcttagcatctgtgtggaatataatatataaaagtattgtacagtcgaacatacagagtgatgtacccaagatcactcacctgtgcattggtaatgccaagcctagaattctggctactttctgtttctgttaattttcaaaattagctcaataaatgtaagaaagacaggaagaggtgcatgtctaatatgctccattatcttagacacttataaagtagggatttttttaatagttgggttttgcagagactgttagacctcatggcttctaagaattgataattgcatcagattgcaaatatgaatatactgtatccattttaataagtataaaatttctttttgatactagaagctgtaagtatgctatgtacctagaaagtaatgtttttcttgcaaatttatgtttaatgtgcatgactagggaacattagcataggtgttgtagcatttaactgctgcttaaaatttttgagaataggccaggtgcagtggctcatgcctataatcccagcactttgggaggcccaggcaggaggattgcttgagtccaggagtttgagaccagtctgggtaacataacaagactatgtctctatttaaaaaaaaaaaatatatagccaagcatggtggcatgtacctgtagtccagctacttgagaggctgaggcatgaggatcacctgagctcaggagtttgaggttacagtgagctgtgatcaccactgcactccagcctgggcaacagagcaagaccctgtctcgaataaatttttttgagccaggcgcggtggctcatgcctgtaatcctagcactttgaagaggccgaggcaggcggatcacctgaggtcaagtgttcaagaccagcttggccaacatggtgaaacccggtctctactaaaaatacgaaaattagctgggcatggtggcatgtgcctataatcccagctacttgggaggctggggcaggagaattgcttcaaccgggaggcggaggttgcagtgagccaagatcgcaccattgcactccagcctgggtgacaagagcaaaactccgtctcaaaaaaaaaaaaagaaaaatttctgagagtatatcattagaatctagaacttgggtaaaggaagttaactataagggagtgagagaatttttgtgaaatgtaggtatgcagtatttgatacagatttgtcttggtactattaatagcctcactttacaaatgaaggtttagagctgttaagtaactcaacaatttcacacagtcatagcatcagtattagaaccctgctctgtctctagagcttatgtttttaaccattatgctccaatagttgacatcttgaggtctgggactatgtcttcattcactctagagatatttattaagtgcctactatttttattaatcactgttctaggagctagagatatagtaagtgaacaaaagagacaaaaatatctgtgaacaagagacaaaaatagaatggagcatacattctagtggaagaagacagaaaataagtaaattttataatataaagttgttttttttttgagatagagtttcactattgttgcctaggctggagtgcagtggcacaatcttggctcactgcaacctctgcctcctgggttcaagcaattctcctgcctcagcctcccaagtagctggaattacaggcacgtaccaccactcccagctaatttttttgtatttagtagagacggagtttcaccatgttgatcaggctggtctcgaactcctgacctcaggtgatccacccgccttggcctcccaaagtgttgggattacaagcgtgagccactgtgccaggctataagttaattttttaaaccactttattgaggtatgattggtattcaaaaagctgtatgtatttattatatagaacttaatgagtttggagataagtatacaagcatgaaaccatcaccaccgtctgtgccataacccaagcatcacctataaaagtttattctcatcctcttatttattaagtatacgatacagtattgtaaactgtatgcactgtgctatataatagatctctcaaacttaatcattttgaaagtgaaactttgtaccctttgactaataccacctgtttcgccagccccaaggccctcgcaatcactgttctactctgcttctatgagtttgttgtttctagattcatcatataagtggcattatgtagtatttgtccaaaaagtatctggcttaatttcacttagcataatgtcttccagtttcattcatgttatcacaaatgccaggattttctttttatgactgaatagtattctgttgtgtgtatatgccacattttctttatccattcatctgtcaatggacatttaggttgtttccatgtctaggctattgtgaataatgctgcagtgaacatgggagttcagatacctctctgacatactgattttatttactttaaatatatacccagaagtggaattgcaggatcatatggtagttctattttaagttttttcaggaactttcatactggttttcatagtaggtgcaccaatttacattcccatcgactgtacagggttccattttatccacatcttcactaatacttgttatcttatatatatatatatatgtgtgtgtgtgtatgtgtatatatatatatgtgtgtgtgtgtatatatatatatatatatatatatgtatatatatataatgttcatcctaacaggtgtgaggtgatatatcattgtggttttgatttggaaatcaaatcacctgattaattggtgatgttgagcaccttttcatgtactcattggccatttgtatgtcctctttggagaaatgtctatttaggtcctttgcctattttaaaaattgggttatttgtttgaattttggggtttttgacattcagttgtaggggtttcttacatattttagatatcaaccattcattagataaacggtttgcaaatattttctcccattctgtaagttgccttttcatgttgttggttgtttcttttgttgtgcagaagctttttagtttgatacagtcccgtttgtctatttttgcttttgctgctggtgcttttggtgtggtgtcatatccaagaaatcattgccaagtccaatgtcaagaagtttttttcctgttttcttctaggagttttacagcttcaggccttacatttaagtatttaatacattttgagtttatttttgtatatgatgtaatataagagtccaatttcatttttttgcatgtgtatctccaaaggtaatcagttttgtgaagaaaagtaaaacaaagtgggatggcagggagtaaataaggtgggtgagcaaagcttcactgagaagttgttgttcgagcaaagtacaaaggaggtaaggaaatgatcatatgataagaccattccaggtagagacagcagcaagtgaagctgctataaggcaggagttctggtgtgctcaaaaaacagcagcaagggcagctggagccagtgagtgagaaggagaggaaaatagaaaaggaaaacatagagatgtcgatgcggggatcagaacatataggacattgcaaggactttggcttttgctctgagtaagatgggaatcagtgggttttcaaacagagaatgacataatctgatttattttaaaaggatcattctgacttttatactgagaacaaactataagaagataaggaccaggcatggtggcttatgcctgtaatcccagcactttgggaggccaaggtgggcggatcacctgaggtcaggagttcaagaccagcctgaccaacaaggtgaaaccctgtctctactaaaaatacaaaaattagctgggtgtggtggcaggtgcctgtattcccagctcctcgggaggctgagacaggagaaccacttgaacctgggaggtggaggttgcagtgagccaagatcacaccactgcactccaacctaggtgatggagcaagactccatctcaaaaaaaaagataagaaatgtcttgttaattctggtattccaaataagcaatacagtatatctgctacatattgtatgtgctaatgaatgtcaaaagccttataattttccatagcaatccaactttataatatctttagataggccgggcatggtggcccatacctgtaatcccagcactttgggaggccgaggcagatggatcacctgaagtcaggagttagagacctgcctggccaacatggtgaaaccccatctctactaaaaatacaaaaaaattagctgggtgtggtggcatgtgcctgtagacccaactgctcgagaggctgaggcaggagaatcacttgaacccgggaggcggaggttgcagtgagctgagatggtgccgctgcactccagcctgggcaacagagcaagactccgtctaaaaaagaaaatctttagataattagaacatttgagtgtggattagatattagatgatataaatggtattttttaggtatgagaatggcacggtaatcatatttaaaagaagggttatcagaggtatatatagaagtatctactgataaaattattagtgtctagatcttgctttcaatgctgcagcaaaaataaacaaaaatgggaagactgataaagtaggtaaaattttgataattgttaaagcaggtgatggatgcatggggttcaatatattatatggagttcattatactcttctatctacttttgtatatatttaaaatgcccataataaaaagacagtggccgggcatggtggctcatgcttgtaatcgcagcactttaagaggccaaggtgggaggatcacttgagcccaggagttcaagaccagcccaggcaacaaagagagaccctgtctctacaaacaaacacaacaaaaattagctgagtgtggtggcacatgcctgtggtcccacctactcaggaggctggggtgaaaggatcgctggagcccaggaggcggaggttacagtgagccgaggccatgccactgcactctagcctgggcaacagaacaagaccctatctcaaaaaaaaaaagaaagaaaaatatatgtatataacattttacttggtaattctacctttaataatttatcataaaggaataatcaagaaaaaataaataccaaaaaatagaacaaaaaacaaaaacaaaccaaaaaattattagatattctgaaagataagtaagaagattctcatcttagtgttttcataatagctaaaatttgaacaacctaaatttctaacagttggaaaataaaaactggtataacccatgcagtaaaatacatgcagtccttaaattgttttcaaagactatttaatgatgttaaaaatggtcacaataaaacataaagtgaagaaagcagaatgtgaaattggatacaatattaccacaattttgactaaaaagtacctataaatatacatatatattttaagggataagagtctccctctgtcacccatgctggagtgctgtggtaccatcatagcatgttgtgacctcaaacttctgggttcaagcaatcctcccacctcagtctcctgggtagcttgtgctacaggcaagcaccaccatgcctggctttttttttttttttttggggacggagtcttgctctgtcacccaggctggagtgcagtggcgcgatctctgctcactgcaagctccgcctcccgggttcacgccattctcctgcctcagcctcccgagtagctgggactacaggcgcctgccaccacgcccggctaattttttgtatttttagtagagacggggtttcaccatgttagccaggatagtctccatctcctgacctcgtgatctgccctcctcggcctcccaaagtgctgggattacaggcgtgagccaccacacccggcaaaatgggcagacatctgtaactaactcattagttcatattatttgagagaaactgctctagccgtctcagtacatcctctccaccatgaagtaagctccatgagggcaggaatcttttttttttttttttcttttcgctctgtcgtccaggctggagtgcagtggcacgatctcggctcactgcaagctctgcctcctgggttcacgctattctcctgcctcagcctcccgagtagctgggactgcaggcacctgccaccaagcctggctaatttttttgtatttttagtagagacggggtttcaccgtgttagccaggatggtcttgatctcctgacctcatgatctgcccgcctcggcctcccaaagtgctgagattacaggcgtgagccactgtgcctggcctatttttttaattaaaaaataattttgcggctaggcacagtggcttattacacttgtaatcctggcactttgggaggccgaggtgggtggatcagttgagatcaggagttcaagaccagcctggccaacatggtgaaatcccatctctactaaaaatacaaaaagtagccaggtatggtgaccgccacctgtaatctcagctacttgggaggctgaggcatgagaatcgcctgaacccaggaggcagaggttgcagtgagccaagatttcaccactgcactccagcctgagtgacagagcaagactccatctcaaaaaatagtaataataataataatgattatttttgtagagacagtctcactgtgttgtccagtctggtctcaaactcctggcctcaagcaatcctcctgcctcagcctcccaaagcactgggattacagggacgaactaccgtgcctggccctataaatatttatagataaaagactttgaggaaatatgctaaattattaataatattctttatctctgagtgataggatttcacatcttttgattctttatactctgtttttctaaagttttcttttatgcttacctacttttattaaaacaaatggaagaggggaatgtaaattagttcaaccattatggaagacagtgtggcaattcctcaaagacctagaaccagaaataccatttgacccagcaatcccattactgggtatatacccaaaggaatagaaatcattgtgttataaagatacatgcaggcatatgttcattgcagcactattccatatagcaaagacattgaatcaacaaaaatgcctatcaatgatagactgggtaaagaaaatgtggtacatatataccatggaatactatgcagccatacaaaggaatgagagcatgtcctttgcagggacacggctggaactggaagccattatcctcaacaaactaatgcaggaacagaaaaccaaacaccacatgttatcacttataagtaggagctgaacaatgagaacacatggacacagggaggggaacaacacacagtggggcctgtcagggggatgggaggagggagagcatcaggaacaatagccaatgcatgtggggcttaatacctaggtgatgggttgataagtgcagcaaaccaccctggcacacgtttatgtaagaaacctgcacattctgcacatgtatcttggaacttaagaagtattattttttaattcaaaacataaaaaaaaagagactataaaagtttcaggtttaaactttttgacccagtaataaccctaatataaggataaggaaataggccaggcacagtggctcacgcctgtaatcccagcactttgggaggctgaggcaggtggatcacttgagatcaggagttcgagaccagcctggccaacatagtggaaccctgtctctactaaaaatacaaaaattagatgggtgtggtgctgtgtgcctataatcccaggttctcgggaggctgaggcaggaggattgcttgaacccaggagacagaggttgcagtgagccaagatcgtgccactgcactccagcctgggtgacagagcaagactcagtctcaaaaaaaaaaaaaaagataaggaaatagtcaaatgtggataaagattcaaagattcatgttccagggcattcattgaattgctgggttttatttatttgtttgtttttgttttttgtttgtttgtttgtttttgagacagagtctcgctcaggttctagtgattctcctgccttagcctcccgagtagctaggattacaggtgtgcaccacgcccggctaatttttgtatttttagtagagatggagtttcaccatgttggccaggctggtctccaactcctgacctcaggtgatccggctgcctcagccttccaaagtgctgggattacaggagtgaaccaccacgcctggccgaattactgtttttattagcagaaaagttggaaatgtctaagtgaccaacaaaggaagaatgattaatcgtgatgcatccatattatgcagctactaaatgttttcaaagcatgaaatacagaaaatgctcatggtataataggaagattggtaaatttcatgtttaatatgatttcaaatacattttttaaaaatgaaagattgaagagagacaaaacgttagcaggtttggggtgatgttaatttttctgtttttttttttttgttctccgaattgtctacactgatcatgtattattttataacttaaaaaatttaggctgggtgtggtggctcacacctgtaatcccagcactttgggaggccgaggctggtggatcatgaggtcaggagttcaagaccagcctggccaagatggtgaaacgccgtctctaccaaaaatacaaaaattagccaggcacggtggcaggcgcctgtaatcccagctactcaggaggctgaggcaggagaatcacttgaacccagagggcagaggttgcagtgagccgagattgcaccactgcactccagcctgagtgacagtgagactccatctaaaaaaaaaaaaaaatttagtctggtcatggtggctcacacctgtaatcccagcactttgggaggccgaggcgggtggatcacctgaggtcaggagttcaagaccagcctggccaacatggtgaaaccctgtgtctaccaaaaatataaaaaattaaccaggcgtggtggcatgtgcctgtaatctcagctacttgggaagctgaggcagtagaatggcttgaacttgggagacagaggttgcagtgagccaagatcatgccattgcactccagcctaggcaacaagagtgaaactccgaatctgatttgtatgtaatgagggaagcctgtttagctgtatgtctcccagcagtgctcactagtctggtagtaaaattgaggggggcgaggatggtagtcatctagcattagaagtgcttggcaaaggttacaggagtctgtgttggtggtctacctccatggttgatgtgaagatgttttttataaactgtaaagttctacacgaataatagtggtagtttttaatctatccccatgccactgtcctcattcaagccctcattattcttacttaaacttattgactgcttttcctgcctccatgctctctccaaaccatcttttacattactgcccagagttctttttctgaagcaccggtaagatggtggtggttttttcctttcagaaacctgtgttggctctccatgtctgaacttttaagccacaaatttgaggcctttttattgtttattttattttatttatttatgtatttttggagacagagtttcgctcttgtggcccatgctggagtgcaatgctgtgatctcagctcaccgcaacctccacctcctgggttcaagcgattctcctgccttagcctcccaagtagctgggattacaggcatgcgccaccatgcccagctaatactgtgtttttagtagggacggagtttctccatgttggtcaggctgatcttgaactaccgacctcaggtgatctgcctgtctcggcctcccaaaatgctgggattacaggcatgagccaccgtgcctcgccaaggcctttttgaatgtgatcccaaagtacctttctaccctaatttctgactacatctccatatactgttttctctgtcctcatcatcctacctacctttccctaaatatgcgaggcttagctaaccctctgttcttgctcatgctatgtcatgtaaaacatttgaaggacaaactttggacttacagttagatgacttgtattactgctttggttctgctgttcacaggtggctgtgtggcctttaatatattattttaacctctttgatcctcaggggtttgttgtgtgttttgtttgtttgtttgtttgtttgtttttactaatttcttcatctttatactgttaatacctacctcaaagaattgttagaatttattcagataatgaatacgaaagcacgttgtaactagatgcacagtacacatgtatggcattattttctacctacctctgtcagtatgcttttgacttcaaataacagaaatccaactgaaaatggcttaaacaatgaggaagcaactctggaggtaaggcggttccagggttggttaattcagcagctcagtagcatcgtcctactatctccctgctttgtactctttgttttgttcctttcggctttttacactatggtcttaagatggctgctacagtcttagttgtcacatgaagtcagcaatgttcagatgcaggaaaggaggagtcctattagtatgaccctctttaagggtgagaaaatctctctagaagccttccctcatccccaccccataaactttgcccaatgtctaattcatggaaattgtaccacatgcctaaccagtcatcactgggaagggaaatcagctaatcttcattagcttagaccaatcatgattcactcgctggtactggccgtcacctctcctgaaggaacagatgcttattaggggctctattagggagggaaaagattgtgacagcacgatgtcttcagggatgaccctggtttgttagggcaaggagatgaaaggaagaggtgctaagtagtaaatcagcataaaggggagcttgcttttggtgactcaagatttcaatcaggcatcatacaaaatgctgagagaacagatggggtgggaagaatgtgaaactagttttacattgcagtttcaaagtttatctttatatccaaataggtatgcagtggaactgatgaagaccctgatgataaaaacgcaccctttcggcaacggccattttgcaaatataaaggacatactgctgatctccttgatctttcatggtctaaagtaagaaattcttatttgaatcatatagtaattctgcgtataaggagctgatgctgtagtcttaaagcagaatttcttctccgggaaacctcagttttttgtcttaaggccttcaactgattggatgaggcccacccacatagtcaagggtgatctcctttacttaaaatcaactgattataggtattaatcacatgtacagaataccttcacagcaacaactagattggtgtttgattaaataattgagtactagcttaataattaaataattgagtatagctaagttgatacataaaattaactgttataaccaccttcttaccagaattaacaccttttctttgaactcattctccttaacctttctctagcatttgatgatttgatgctattgatctttcttgaactacttgattttggagcactgtatgttctagattcccttcctatctcactgactattcccttgtttccttcatggaggaaatatgtaatagttaaaaaaaaaaattgagaacctgtgcaactatacctgctatgtaccaagtacttttcattcactcaaaacatatctgttgatcattttaccacctggttaagaaatgacccctggagccagactcccaaggtacatattcttcctagtctgccccttacattatgtgaccttgggcaagttatttaacctcaccatgcctcatctgcaaaatagacataataaaaataccttcctcatagtgttataacagggaaagattaactgagctagtaaatataaagcacttgcctagaacataataaatgttcaattaatattagcagtgatgataatgattaactgagctagtaaatataaaacacttgcctagaacataataatgctcagttaatattagcaatgatcgtcatcatcatcatcatcactatctgccaagtagcattttagccactggggacacagacaaaagttaagtactttacatgtgctctgttcgtaccctcaaaacaaccttatgcgattgttgatgtttccttatcaaggatttaaaaccaagggtcatacgtgttaaagaacatgcttaaaggcgtatagctagggagatacgggagtttaggttcaaaccctatgacttcggagcattactctctagcccattccagtgtcacagtagctaatcactacaaggaaacaggatgacaaaaataacaaatgttggacacgttgaaagatttaagaaatcataaattttttatactttccgttttatactttatttccattctatctcttaggaggcagcagtaatatgatttagtatctatccagctacctaattgtctcaagtgagtaatgtgcatttttaaggactggtgccagcctataaaccacctggtcttcctggtccttgacgatacaaatatagaataccagtctgtgaagagataagtgcagaaaccaagagtaaactatttagaagtgtttatggcagttttcacaataagtttatacctgtttaatcttttaaaacttgggcttctattttgtataataatacaaaatggggcttttattttatatgacttttatttttatttcatttttctagtaaatgttttctgtattttaaaatagtttcagtccacaactcattggaaatttaaaaaaacaaaaacaatccttcaccagaaatagtctgagaagcactagtctagatgagttatttcaatgaggtgctgccccatgcaggaatggttcctaaaggtctatcctcatatccccaacccctccaccccacctccatccagaggaaaggaacaaaatttctgcaacaagattctaagcctctccagggtaggaaccagatattattttactgttttttgcttttcaaacaccaactcaaaccagatattgtttctctttaatgtctatcacagtgtttttagtgagttttctatttgttgaaggtgtattttgtgccaataacaagaattaccgtgttaattcttacaataacaaccccgtgaggtagacaacctgattttgtctcgaggaagagattgagcccctgtgacctatctaaaatcacaaaattagttatgggtagaacttagattttaatctaatttatctgacttctaagatcagtgcttagtttaagaacgttatttaatttcgtttatttaataaaaagtatttattaaatacttataaaagaacaagtctttcttaaagaatacttatttggaacaagtcttaacatgtcttcagcaccttcacttaatattttagggatgtcttcatacctctttcatatgctcaaagcaatgagctattgcaggaattgaatacagtcagtttctgttttttgtttttttcttctgttttcttttttttgagacagagtctcgctctgttgccaaggctggagtgcagtggcacgatctcagctcactgcaacctccatctcccaggttcaagcgattctcctgcctcagcctccccgagtagctggaattacaggcgtgggccaccacgcccagctaatttttttttttatttttagtggagatggggtttcaccatggtggccagactgatctcgaactcctgacctcaaatgatccacctgcctcagcctcccaaagtgctgggattacaggcatgggccactgtgtccagccaaataaagtcagttttaatgaacataggttcatggtgtgccataggttaagtttttatacagttggtattaatcaacaggaaattataatgcaaactgcatatactcttaaaaacttttctggaactgagtggatcttgaaaataaaaatgattgttagatatttcaaagattattgtaaatttccaaattctgttttttaattctttacttttaatcataaagtataccatctatttgaaaacaggtataccacaatgtacctacttcatagtgttgctatataatgcgaagaacaatgcttaacacatcgtaagtatgcgatcaatgtcaccattgccttgatttgtttagcacctttaggcacaccaaagaatacagaggtatcatttgagttttctcattcagtataactcatagttctcctccttaaatagattatgttgaggaattaatgagcttctgccagctgaaagcttttgacagatagatgtttgtttcctgggcgatggggccatcacggtgcctaagtcagttacactaccatcttctagccttgaacattctgtgatctattctgaaagatttgacaatttctattctctaattttcttgcctagagtgtgacaggtgcacaataacttttcatttccatgctgcattatagggtaatctttttgaagacattttaaatgacaattagagatctatgtgagttaaaattcaccagtgttatcaatgtgaaaataactgaagtgacaataaaatgaatagatgccttatactgatagctaagttccaatatgtgcaggtgataacaactaaggcacaccttagttctctgctggtgcctggcagatttctttagacattgataagattcatctgaatttcagaacaggtaatgtcaaaaagttttagaatcagtgaaatatggtacttaactgtttgggggaaaataggatcttccaagtgaatttgataatcttttgttctttccgatgctgcatttaacaataacaaaactgttgagatacaaaaaccaaaagttcacttttattgtataaatagggttctttttcatatagtgataacatagtcaatgtcattttccccatagaactactttcttctttcttcttcaatggataaaacagtcagattatggcacatttctcgaagagaatgcctttgctgttttcaacatatagattttgtcactgccatagcttttcatccaagagtaagtaactatttatacatgtttttgttaacctctaaggaaggtgagagaacctgatttctctagagggcaattggactacaggaaaaaaattattaacagctacatagttatgagcaatttaattttgtgtttcattttgctttagaaatgagaaaggaaatattctgctgatctgcattagaaaaactggggatattatatcctaaatctttattaagacatgcaaggtataaataaatgaaataaagtatcctattaaagatgagagatattggagatggaggaagaagagacagcagatggataaatgagaaagggaagtacctaggcagaaataatgagaagattggggagggaagagacagagaaaaagactgaaagaggcaaagacgaaaattcattacaagatacactgaattcatattgttagtcttgatatcccttctttattccttttcagtatagaaaatcctttcatatctttcccccagaaataaagtatttcatatgatttcagccaaatgagaaaaatctgctgtcatggaattgcagacctattgtatgcccttagaggatggagccaccaaatgcttaaggctaaattagttacagatttttgcaactgtaagcaaaagggaaatcacatgttggtgctgactgcactagctctattaagcagaggactcgagctgaccctagcaacaagtttcccttacctaagttggtgttatgattacatttccagtggtgtcctcatctttatatgtttaacacacattatctttttaatgtaacattttaatcatattcacatttcttcatctcccccaaattaagaagactgacttgttttcaatatactttccttccctgagcaggcttgtaacataagcagtgataattccgaacccttgaagacttggttaagggccaggcgcggtggctcacacctgtaatcccagcactttgggaggccaaggtgggcagatcacgaggtcaagagatcaagaccaacctggccaacatggtgaaacattgtctctactaaaaatacaaacgttagtcaggcatggtggcaggtgcctgtagtcccagctactcgggaggctgaggcaagagaatcacttgaacccaggaggcagaggctgcagtgagctgagatcgcgccagcctgggcaatagagcgagactctgtctcaaaataaaaaaaaaaaaaagaggaagaagacttggttaagaattttggtggctcacgcctataatctccgcactttgggaggctgaggtgggaggatggctttaggctgggagttcaagaccagcctggacaacacagtgagaccccacctttatcacacacaaaaaaactatgttaattcttaccagttttgatgatcaagtcattagagtcctgtttctgaataacacccccatccctgttccctatacacacaacaaaaggatggatttaccccatcagcaactgtgagcaaaatctttccatccataaatctttccataactattttagctataaagtatcagcttggaaagagatatttggttgtgttcgttttctttctctttcttttcttttcttttctttttatttatctatttttggagacagggtatcactttgtcacccaggctgtagtgcagtggtgcagtcttggcttactgcagcctcaacttccctggctcgggtgatactcctgcctcagctccccaggtagctgggactacaggcatgcaccactatgcctgcactatgcctagctaatttttgtatttttagtagagacagggtattgccatgttgcccaggctggtctcaaactcctaggctcaaagcgatctgcccacctcggcctcccaaagtgctaggattaaaagcatgaaccactgcacccatccagttgttttccatgtggtattttattatttattaaactttctgttcagccatgtttttttttttttttttttttgaagacagtctccaggctggagtgcagtggcacaatctcggctcactgcaacctccacctcccgagttcaagcagttctgcctcagcctcccaagtagttgggattacagacatgcaccaccacatccagctaattttcatatttttattagagatagagtttcaccatgttggccaggctggtctacaactcttgacctcaagtgatccgcctgcctcagcctcacaaagtgctggaattacagacgtgagccactgcgcctggcccagccaatgattttttatagtgcttttatttggttttattttggaaactataaagccctatttctaaaaatcgtactgacctggagtgtttttaagaggggctaggaaagaatagggtagtgatgcctttttttgggggggaaatatgacttttattataatgttaaaggaagaaaggtagcagagttagaaaagaaatagcaaaatgggccaggcgtggtggctcatgtctgtaatcccagcactttgggaggccgaggcgggtggatcacctgaggtcaggagttcaagaccagcctggccaacatggtgaaaacctgtctctaataaaaatacaaaaattagccggccgtcgtgttgcatgcctataatcccagctactcaggaggctgaggcaggagaattgcttgagccaaggaggcggaggttgcagtgagccaagattgtaccactgtaccccagcctgagtgacagaatgagactccgtctcaaaaaaaaaggaatagcaaaatggagatacacatacatagatgtatgtatgtgacaattctgaattagaagactaagttaaagtatttttacttgttcacctcttctactggtacacattgagtgagcttacattatttgtagattgtctttgacaggtttcagagatgggtaagaataataatctttggcaaggaacagaaacccttagggcagggggatttggggtgggggaaggaaaaaaaaagaagaagaagaatcttggctgggtatggtggctcactcctataatcccagcactttgggagtttgaggcaggaggatcacttgaggccaggagtttgagactagcctgggcaacatagggagaccccatttttataaaaaaatttaaaattagcccggtatggtggtgtgcttctgtgatcccaactacttgggaggctgaggtgagaggattacttgagcccaggaggtcgaggctgcagtaagccgtgatcgagcctctgtactccagcctgggcaacaaactgagaccccatcaccaaaaaaaaaaaaaaagaaagaaagaaagaaaaattcttatgttgccaaaaacaaaacaagcttagtggtaggactgatttagtttaaaggagatttctcaatcctagtactattgacattctttgttacacgggggagagtaggctgtgcgttataggatatttagcagcatccctggtctctacacactaaatactggtagcatcctgatcctcccaccagttttgacaaccaaaatgtctccagataatgctagatgtcccctgcaaggtcagattgccgcaggttgagaaccgctgatttgagagcagaatttgaatgatgaagtaattctctgttgacatggtgttagagttccaaaaatgactggttttgggggccactaactgatgttactctttatccaagtgttacatgtatcccagaggaaggtatgatataggatagtgtttcccatagcatgttcctgaaaggtctagcacctcccgtaaacacgcccccccaaaaaaagtctgtggttaaatatgttgaaaagtgctacctactttatcctgtttggagattcaaaatgcaggttaactgagaatcatgtttaactttttgtaacccagaatttctcaaacttatttgatcacagaaccttcttccatgcaatacacactcaaacactttatctattgacatccatatcttgcaaaacagcagtttaaggatatgataattagaattttatttctccaaagtgaatagtgaggtttcttattgttgttactgctttcagtgcataaaataatgcttgcttaaagaataaaaatttttaaatgaaatctttttttttttttttttttttttttttttgagacggagtctcactctgttgccaggctggagtacagtggtgcgatcttggctcactgcaacctccacctcctgggttcaagcgattctcctgcctcagcctcccgagtagctgggactacagccgcgcaccaccatgcccagctaatttttatatttttactagagacgaggtttcaccatattggccaggatagtgtcgatctcttgaccttgtgatccactgccttggcctcccccaaagtgctaggattataggcgtgagccaccgcacctggccctgaaatctacatttttaaactattctaatagacttactgatttgatttgctaatgagttttttcttgatgtggtaaaatgaaaactttctctgttgccacctctttaggatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagaggtaaatgattgttttttgtaaattatataattgtatacttagtaaacactttcatggttttggacaagttgcttatcccctctgggctttaactgcattttctctaaatagagacaaataataccatgtctgtcttaagagttggaacagatgacttttgagatgtcttctaattctaatttaaaaaaaatttttttttgagatggagtctcactctgttgcccaggatggagtgcagtggagcgatctcggctcactacaacctctacctcctggattcaagtgattcttgtgcctcagcctcctgagtagctgggactataggcacgtgccaccacactcagctaatttttgtattttttggtagagatgggatttcaacgtgttggccaggctggtctcgaactcctgacttcaagtgattaacctgcctcagcctaccaaagtgctgggattataggcgtgagccaccacgcccaagcaaaaagaatttttttatagagacaaagtctcattctgtcacccaagttagagcgtagtggtgcaattgttgctcactacagcctcgaactcttgggctcaagcagtcctcctgcctcagcctcctgagtagctagagttacagatacgagccaccacacatgctcctaattctaatatgttaaatgtatggtttatttttagcatttgaaataccatacacaaatacatgtccgatctactagagggcgcaacaaggttggaagaaaaattactggcattgagcctttacctggagaaaataaggtactacagtattcaaaaccatctctctccatactatatgtagattcttgaaagttcttaatatcttggcaaaaaaatgtattctctttgttgtggaataccgcttttcttctagttttgaggtatattagtttgtatgtgtgtaacaccctttttgggttgtagcttagcttgtactaaaagatgatatttttaacttttcatttgatctacttttagatattggtaacctcaaatgactccagaatcagactatatgatttgagagatttgtcactatccatgaagtataagggttacgtcaatagcagcagccagatcaaagcaagtttcaggtaaattggcaatgagatgttcccaaaagagatcaggacatttctcccctagttccatttttccattggtctatgccttatgtttaatggggttcttttcacttttgcaagtagtagtttattatcatgcaatacgtaccttgtccacctatatagtatatagaattcgaattgaccctgttctgcaaatgaagaaaccaagactcagaaaattaagtgattggcctaaagtcatggttgtagagccaagattatgaagactctcatctctagagtttttgcttttgtacctttgtttacgcttttaagagggggcttacggctcatcccgccactcccctccctgccccattgtcttgaaccttttaggaaaggaaggaaccttttaggattctaagaaagcattttaacaccccacagcacagggtcttgtattcaaaactttacatatcattattatttaaatttctaatttgggttctggacactctcctgaaatagggttagctaccttttcttctttctagccctcttcttttgccgttttcttaccagttcttttttcttgaattatacattaattaattcaattggtaaagtattctgctcctgtctttcacaccttaaatcatcattcctcccaacgtggattaactaacatcacagttacttagagctttgatgcaaatacaagtgccaggccactacatcacacgtacacatttagaacatctagagtgagaccatgggtctacatattcaacaagacccttcaagtgttattttaggtatcacaaagtaggaagcactgataaaggaaacctttaaacatatacacacacacattttatttgcttttcctttctccccaaaattcagccatgattttacttacctcgttagtggttcagaagataagtatgtttatatctggagtacctaccatgacctaagcaagtttacttcagtcaggagagatcgtaatgacttctgggaaggtattaaaggtaagtacatacttgcttttgtgtgtcttataagagaatcaagttacagtggatatatactagaagtaaattcatgaccggacacagtggctcacgcctgtaatcccagcactttgggaggcccatacgggtgtatcacgaggtcaggagatcgagaccatcctggctaacacggtgaaactctgtctctactaaaaatacaaaaaaaattagccgggcatagtggcacacgtctgtagtcccagctacttgggaggctgaggcaggagaatcgctggaacctgggaggtggaaattgcagtgagccgagatggcaccactgcactccagtctgggcaatagagtgagattccgtctaaaaaaaagacaaaaaaaaagaagaagtaaattcatttaggcattattttagagaggcagtttgacaatgataaagtgccttgcatttggctttgcttgttttatctatactaaggaagaactttggtctaaaatttgagaagtcagggaatttcagaacttatatgtgattttttttagaaaaatttttgggttttaaatcactcttagttacttctatgttagtttttaaggatatttggcatataacatacactatcgtgtttgtcttggtatccaatttgtcagttatcctgaagtaaattttttccacagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtaaatctttacttgtcctatatttttttctagtcagcacttagtagcctcatttatctcatttgagtataataaggttttcactagtataaagaatatttcttttttcttttttcttaagacagggtcttgctctgtcacccaggctggagcgcagtgacgcagtcacacacagctcactgcagcctcaaccaccctggactcaggtgatccttccacctcagcctcccaagtagctgggactatgggcctacaccaccatgcccagctaatttttgtattttttgtagagatgggatttcaccatgttgcccaggctggtctcaaacttctgggctcaagcaatgcacccacctcagcctcccaaagtgctgggattacaggcatgagccaccaaagaatatttcttgtttgcaacttaatggttgtcagatatccatttctgaacttttcagtaatatatttcctcaaagttttacctgttttaaattcacctgagaattaaaaatgagaaatttgggcctggtgcggtggctcacacctgtaatcccagcactttgggaggccaaggcagatggatcacgaggtcaggagatcgagaccatcctggctaacacggtgaaaccccgtctctactaaaaatacaaaaaattagccgggcatggtggcgggtgcctgtaatcctagctactcgggatgctgaggcaagagaatggtgtgagcccgggaggcagagcttgcagtgagctgagatcgcgccactgcactccagcctgtgtgacagagcaagactccatctcaaaaaaagaaaagagaaatttggatgttcataactatgggtaaccattctctttagagaagtgcaaacaatatatgcaaatgtaaaacttctttattacctgtctctcctactagtctgtaatctctagaagacagagacttttcatgtcttatttattgctgtattgccagtgtctctcacaatgcttgcctacacatagtaggtgcttgatgaacatgtgctgactaaatgaattaaacccaaatgaagcagggctaatttttctacttgccacaagttaacagcttcttgagataggtggctatttacaagtttgtaatttcttgccatttgtagcatatatgctttgagaatgaatattaattccagttatatacaatgctcatattaggaagggagaagaaactgtcagcaagtaatattgagtgccaatcagttatataaaaatctgggccaggtgcggtggctcacgcctgtaatcccagcactttgggagaccaaggcaggcggattatgaggttgagagttcgagaccatcctggccaacatggtgaaaccccgtctctactgaaaaactgcaaaaattagctgggcgtggtagtgcacgcctgcagtcccagctactcaggaggctgaggctggagaatcgcttgaaccagggaggtggaggttgcagtgagccgagatcacgccactgcactccagcctggtgacagagggagactccatctcaaaaaagaaaaaaaaaaaaaaaaaagaccaaggtgagcagattgcttgaggtcaggagttcaagaccagcctggccaacatgttgaaaccctgtctctactaaaaatacaaaaagtggccaggtatggttgcacacctctgtaatcccaggaggctgaggcaggagaagtgcttgaactcgggaaggtggagttttcagtgggctgagattgcaccactgtactccagtctgggtgacacagcaagactctgtctaaaaatatatatatatggcaggcgttgtggtatgtacctgtaatcccgggtatttgggaggctgaggcaggaggtcttgagcccgggcaacatagaagaccagcccgggcaacatagaaggacacccaactcaaaaaatatatatatgattcttttttaatttttaaatcgattgcataatagtttattgactgtattgtctcatgctacagattacaaacaggtcataaagccacaggaatagatacagtgtacaaagagtgcttctaaagtatttgaatggtaaaaagttatcaagtactttaatctcaagtaatttttttgtagtattatttggactatctactccactcatgacacttttccttctgtctgtgaagaaaaattttgataacaaagatgaacttcagtctagcatttctttcagtacaagatacaaaaataaaccaagttagaatgattaaacctttactaaatgcctgtttaactgctgtctgttttctttttctttccttctcagaatcacatccagcttctgtcttctaacttaagtcatttacgttttttctttttttttttaacttatgaatgaatgaatgaatgaatgacatggtgtcgctctgttgccctggctagagtgcagtggtacaatcatagctcactgcaacgttgaactcctgtgctcaagcaatcttcctgcctcagcatcccgagtagctaggactacacgtactaccatgcctggctaattttttttttttttttctttttgctagcaatgagttctcgttatgttgcccaggctggtctcgaacttctagcctcaaaaaggttagtcctactttggccaaagtactgggattacaggcatgagacatcatacctggcctttttttcttttcttttcttttttccccagtgctacctttttacattccatatacttcccctgcatattccacaggaaattctagcttttaaaacaatttgaggaaaagtaaaaagtacagggttttttttaacttctcaaaaatataccacattaacaaggttcagttaactaactgggtccttttttaagaggcacaaattttagtggattgtactcagatttgtgtttgtcattttgtacccatgtaggtgtagtctaagaataagctctcttaaacccaaaatgtgggatcacaaaatatattcaattcccctctctctttgttcctgacgtgtttggcaattcaagcctcaattttccttatgtgtaaaataatgatgataacctagtttatagagtttcaataagaattagatatgacatgtataggctgggcatggtggctcatgcctgtaaccccaacattttgggaggccaaggcaggaggatcacttgagaccaggagtttgagaccagcctggacaacatagcaagaccctgtcttcacaaaaaattaaataattagtcgggcacagtggcgcatgcctgtagggaggctgaggtggaaggatcctttgagcccaggagtatgaggttacaagaaagctatgatggtgccactgcattccagcctgtgcaacagagtgagactctatctaaaatatatatatatatatatatatatatatatatatatatacttgtatgtgtaaaagtgcctagcaaaatgcctggcatgtagtaggcattattgttatcattttcattattattgtgtcttacaaagcattttatatgtatggtgaattattttcttctctatcctttctcatattcctaagttctttgctgctgctactactgcacagcactgctgtgagatatgccaaaagggtggtaaaggaatgttcaaaggcttaggatatgtttttagcacatctaagtgaaaccattttgtgtgactcatcctgtccacaactttccaattaaagtttggattattttcttcttttttaaatctcaaattaaaatctcagttttcacctatgtataatagagttagttaacactgaatttttttattaagtgcttttatgcaactggcaaatgtaagaggtaagcatttatgccattcagcatagttatatagcttttcagtaaggaccatatggcaaaaggtgctgtcagcattcacacagcaaacgtgtgtacttcatttcatggcagtttcagtatgtctgctatacaataaaccttactggcaacctcgctagacacccctgttagcaacagacttgcccagctgatccgattctgccagcactccagtcctggggctgaatgacacactagcttcttgccatgcaatgaagcattagatgacttagatgcctaggctgcctaggaataggtccaagcatccaggccccaagagactgtaatatcctcaagccagggaaagaccagctaagacaaggtaagtgaaagtgagcctcagagcagaggagagattcagcagaatgaaagaattacaggagccagccagaaaaggagactgaaaaggtggggagatgatcttctcccctgaagctggagggtcatgggcatgtgataattgtggcagcaggcttcatattcctttaaaaatcaacttaaaactattttttatacttttaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgttt

SEQ ID NO: 5851 - DNA, 103852 bp, human
ttttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtaagtgactgcagctatgacaggaagccgggcatcccaagccccccgcatctcctgtgtcttccccctacacccctcccaggtcccgctgtgtccgccaccgctgttcctccccgtctcactggaggacttcagaacccagacctggggcttcttagggcggggtgactcggagaagggggagtcagccacctcgggcagcctcccggccgtttccctactgaacggtcccagggtcggtctcggagcccgtttctcttctgatccagccttctgtgagggggaacagcttacgtgcctgagtcggagatttgtatctgtggggttctgagcttacctttcaaacatccgttttggcctcggggaccgtagattaaaggagcagtaacaggagaaatgtaacttgtagttttttattctcccgtttaccgctaacttacctattcacttcagaggtggctgtaactctcccctatttgccgtcctctttttcttgcacacagcgaaaaggagcggggggaaggttgggtatttgcttaagaaagtcctctagcgaatgtactctagatcaacagtgttttattaaaataacaccttatcgtgaggtaaaggaaatcgaatacacggtccctattaggcagaatgcggtctaaaaggatggccagacagaagaaatgtgcacaactgactgcagagggacaaacaagtgctgagtaatctggtgattggaaggagagccccagctttgtgttctttatctaattctgcaagatgttttagtggtgattaatatgggtgattctgaataggaagtacagtagttggaatgctcgcttgactaggacttgtatttacttacccacttctccacttttcaaagttggggtagtgctttaaagcgatttcgccgaactcccctacgaatgtacgtggaaatagaggcagtgaaatatattttcatgctgtaagaacttgaggattggtaaaatgtagatgttagtataaaggactaatatggttcgagaagttcactgccttcaattctcacacttactccgtgggagtaataacccgctgtgatgcaagtatagttagccatgcatgctagaagtcattctaaaaactaatgtatgtttatacacaatatgcaccaaaaagttacagtaataaaatcagaaagcaatgtacgttggtagatttcagatgtttgtctttccaccaaccttcatgtcactgttgtgggattttggggtggcagtggccaatcttgagatgacaccgaatctccttcaagttcaatatctgagacaagtttagagctaggtgtagagcataggaaatacatttgggttttgaaatgtattggacttccgtgaaacttaatttttgtgtgtgtggttttcccttcaaagtaatgaactgacaattcagattgaatgagacaccaagtcctttggtacttttgtgtgtgtgtattggggtgggggagggaaatcatcagtttatgagctgatcagtttagaactactctgtggatattgttctttccactgaataagtttaatttcaaaggacgcaagttatatcaggacctgtgtaaactgtctagtccagtacctgggcacagagaaagcattcaaaatgttcatgcttttctccttcctttcttggcattggcaaatttgttaactttacacaaagcttattttgggagatatatagaacttggacctattttacttatctaaaccggatgagtcattttgatagaattgatagagtcacttcttccctcatgagataatacagcttctcaagcactttgatcctctgatattaggtgaaaactgaaaaaggtttttttggaactcagctttctaattttaactttaacctgcccaattactaagtgtgttgagttctatggataaaactacagggtcagtttgtggatttcagggctcctttctgtattagaggattggaaagacaatagactaatctggagaattgcatctgaaaagaactggcagcactgagggcagaaaaaggttagcatcatttacattttcctctatcctttgtggaaggttgtatcatttgcataagacaccgtgaggagatctgggtgggcaacttataacctagaaatgtagtgagaaatcttgatttgtggaaacagattgccttactagatattggtcatcagaaatatgttctgttccttcatatgatctggagtggcaaactatacaatttctaaggttaatagactgaatttgggcacttcagaaatgttccttgctgttgtgtgtttgggagtacacagactatgtcaacaaattgtagtaaactgaataggcagtggagacttatctcatgttttgttaattagcacaatcctaatacacaagctatttcctaaaattaatttatttcttgcattttccttccaatgatgtcttcggctttgttaatctactctttgaaagcaaatttaataagttaaaaatcagcccagtttttttagagacttttaattccagtacagcctacttttctacagtggcagatgatcttcacttgcccagctttgcaatatatgccgtatttataatgcttttttattgatattttaggtcaggttttctttattttcttttttcttttctttttttttttttccaagatagggtctcactctgttgcccaggctggagaggtggtgagatcatggctcactgcagcatcaaactcctaagctcaagttatcttcccacaggtgcataccaccctgctcagctaaaggtttttttagagatggggtcttgctatgttgcccaggctggtctcaaactcctggcttcaagtgatcctcccacctcagtctcccagggcgctgggattactgtcaggcatgagccatctcgccaggcccaggttttctcatttttatcttcatttttacatatgaggaacatttttttttttttttgagatggagtctcgctctgtcgcccaggctggagtgcagtggcacgatctctgctcactgcaaccttcgcctcccgggttcaagagagtctcctgcctcagcctcctgagtagctgggactacaggtgtgcgccaccacgcccagctaatttttaggagagacggggtttcaccatgttcgtcaggctggtcttgaactcctaacctcatggtccgcccgcctcggcctcccacagtgctgggattacaggcgtgagccaccgcacctggcctaggaaccttagactcagagacggttaagtgaatttgtcctaggagagagcttttaagtggcagaactgggatttgaaaccagctcttcagactcctagtccagtatttttttttttttttcctgtggagggcgatgagagcagtgacagagaggtggacagagatcctcccctggtaaattctggagtaaaatgctttaggaccaagttgctgaattgaactgatacatctccattaaaaccagcagcctaaacttttttgttctcttggcaagaaattccactttctttcagcaacgtgtatttttgttttgtcagataggaattttgcaagatcatagcctgttgcagctagaagggacatctagttaaactccttcgtgtaaaatgttgtgaaaactgaaacctagagagagaaagcaacttgtaaaagctgccacagcaaattaatggtggagctaggtctagaacccggatcagtttgactgtctggcgttctttctgctactgggctgtcttttgatagagcaggaaagagaagaggaatcgtgtggtacactagaaaagagccctgcactgtgagtcattttatttcctcatctttaaattgaggggattacactcttgagaacccttccaactctaaatgtctttatattgaggtttaatagtgtgcttgtattgataagcttttgttcttggtaaatctttcgtgattttttttaatcttttcgtttaacttaatggtatttggtacatagttcaagacccataaatttgaaattaagtatttactgggtaaattatatatgagatgaatgcccctgctaactcatgtggtttatacttacacatactaaaggctggcactgagaacatgttgtaaaaataaatgtaacattttcagcactcttttttttagtggcagccaaaatatttttgaggccttggaagaaggatagaatcataacatttttagagtaggaagggactggagatcattttagcccagccttcccttttaactgaaagtgaaatttagggtctgagaggggaagtgacacattgctaataagggcagacttggaactagagcccaggtctcttgattcctcacttataccatgctaccatgtctgcggaagaagggaaagtattgctggctattcctgccataggtttctggcacttaccctattagctgggcttttaagatggtttacttgactgtttcttcataccttgcctatcagaggtcttgaactattttagaatcctaagttttgcttacgagttttttccaagtgaaagtgaaaaacaatggcaaaatagcttgtctaagaacagtgattatttgtattattttattcttaggcatttagttagtattaactgcaatctaccatattcagataggaataatgataaaatcttaagtcatgggaactgagaccaaactgtcctgaataattgttaggtctgaaaaacaaaaaggtgtgtagctgcctttgttgaaaactcagcttctcactttacttaggtgtcagaaacatttctctctgaattgaaaattgatacaagttttaatttaaaaaatacctgtgcaatatttattactttagggaagtttccttaaaaatggctgtttgttgatgagttgacatttgatcacaaatttgattactgaaggctttaaggagtgatagaagtatatttacaaatgctgttttatcgcactcatgtaacatcatattgaagtgagaaaaaacaaccctctacatattagttagtaaattcaagttctaaatttagtgacatccggccgggcaccatgactcacgcctgtaatctcagcagtttgggaggctgaggcgggtggatcacctgaggtcaggagttcgagaccagcctggccaacgtggtcaaaccccatctctactaaaaatacaaaaattagccgagcatggtagcacacacccagctacttgggaggctgaggcaggagaatcgcttgaacccgggaggcggaggttacagtgagctgtggtcatgccactgcactccagcctgggcaacagagcaagactccgtctcaaaaataaataaataaacaatttatatttagtgacatctgactgtcagttggtaactcatgggggtaggatagtccatagtggcatggcaatttgggggctcaagttgaatctgtataaactcctgtaaattggaaactgtattctcttcttgtgataatctacttcataagataggacagataaaatttgtgttgtttgttttttgttttttgtttttttttttgagacagggtctcactctgtcacccaggctagagtgcaatggtgcaatctcagctcactgcagcctcgacctccccaggctcaggtgatcctcccacctcagcctcccaagtagctgggaccacatatgtgcaccaccacgcccagctaatttatatatatatatatatatatatatatatatatatttttttttttttttttttttgtagagatggggtttcaccatgttgcccaggctagtctcaaactcctgggctcaactgatccacccaacctcgacctcccaaagtgctgagattacaggtatgcaccactgcacctgtcccttgattttaaaaaatattaaaaacctaaatagttttaggatgtgaagtatagtggtggtcttaaacagaaaataatttctaattattggtattttagacttactgtctaacctttacattacccaacactccatgtgtttgtactcttaagttcattgttaagactttgacagaatcaggtgaatttgccaggcaagcacctttaagaggctgcttgtttcctcctcatactctgcaattttgttagttacttcctggggtagtagtggaggtggaggaagggagtataaagagatcatgcaggttgtggtgatggaggtggaagaggtaaaggtagccccagcagtaggtatagagaccaagttacagtgctgcttcctggggcatggataactgagataagacaaatcccatcattttgatacacatgttcacagcatgaattaaataaccccttctctaagagattaataacctataagaaatacctcaaatcaaagttaaagtaacaaaaattgtaggtactttatgatgtcctactgatatttagcttgaattgataaataacctatgtttctcatttctatccatagttaggctaatatctacaaactttcacaaggactgttcccctctcactgttggatattattcagctaaccagctaaacctttaatagggtgctttccttactcttcagagtgaaactctttctattcccttatttcaaactcagcagtgtttgtgttagtctgtcatctcatgattcaaaaccgaggaaaaagcacctacgacataatgtgggcctcatacctgatggcaaccctgatgtttttcctcagtcagtatacaaatttatcttggttactatagcaaccagtctatcagttattcttctagctcttttgccttctctcagatactaggattaccatataatcaggttctgccagagcgcttcaggtcttagagttctattaccagctgcaactgtctggcagttcacagtttggcattccatcagagtcagttgttttttaagtccacaaaacctttttgtctccaaacctttttaaacattttaaacatatataatttaacaaaaacatgtttaggcagcaatttcctcatactaattttctcaatccagtgttagtcattgccctgaagattgaatgcattgcatcactgcatccaatagccatccctttataataacaagtagaatcaatttccagatcgagggtgaccatttaggaaatatatttgcaaatgtgattttagactcagtatcatcacaaactagctaaaatgacttaaaagcatcttgatcatcagcagctaccaaataatccagcttttaacaaaaatgatttctataggttgtagaaagaatgtttggcctttagattaattcattttaatttgagaaaactgtttagaaaactaataggaagtgttatcttttgtagcccttgaataaacaggaagagaacagtaaagactgaatagttgtatgggtctttttttttatatttatttgacatacttttttaactcttaaaaatctcagaattcatgtaactaaaatagttttaaattataaatatgtttacctgttttggtcaaaacaaggattggccaggtacagaagctcatgcctgtaatcccagtgccatgagaggctgaggtggagggatcacttgaagccaggagtttgagaccagcctgggcaatgtagcaagacctcatctctacaaaaagtttttaaaaattagttggacatgatggtgcatgcctatagttctagctatttgggagattggggcaggaggattgcttgggcccaggaggtcgagggtgcagtgagctatggtcacgccactgtactctggcctgggcgatggagccagactctgtctcttaaaaaaaaaaaaaaactatagttaaattatgataatgcttcaaggaaatctttaattgtacaaatagacttaagactggtttcactttctccacagagtcctgatctttaaaatttttcaaagggggagtcaggtttttaaaaaatctgaggatgaaatataagattttttgaaacttctgagggaaaacttgaatggtatttttttttattatactttaagttctggggtacatgtgcagaacatgcagttttgttacataggtatacactgaatggtattttctaataggtatcctatacagaacaagccatacctgtaacaagctatctatatctgtataaaacctacttggccactactaattgtaatagactattccagtacaaaactcattgaaccatgggcattcttatgaaccacagatcaaactttctagagaacctataaatagtatgtagtgctgtatgcaaactcactgtcccaggagcaagcatcctgattactaagcaagctcaagagaagaggtgggagtattctttctgacattgttcttgaactggtaagaatagctgtggatgaacttaatatccatagtcctcttttaattctgtgcctgaaagtatttattgaaattggaagactaagggaatcatctttctggttattagcagtactgttaacaattgaattttttttttaaatctgtcttttaaaatatattacctatccatgccaaactaaaatggcaggtggattgaacatttcactcagccccaactccacccctttcactgccagctttttctttcctagcatagtcaatgtcattagtacagagatttcctagtataactacttcttgtcccttaaaactgagaagggtcagtgatggaagaaatataaagggtgggaacttttggaaggagtaagggaaaaattggttgcattggatatggtggacaagttggtaaagactttagtgttacaggtggtgcttagtcattggattagtgaaagatgggtgagcagaatgaacaagtagcttgataaaactagtagctttgtgagtgaaagcaagtagatttgtctgtattttgcaatgggtattttatctttattagcttggcttaagggttaaggttaatgattgagatcagtcctttttcctttaagtgcaccttactgtgcctattatgtcccagatcatagcccttagctgttgacttttaacctttgccttatttcccagcatagtccacagttatgtctagcagtgcacacaaggtttagttggggaggcgggtggtgagtaagcatgctctgtggtatctactgcgcttcacaattggttctgattttgaacttcctggttctctccaatctccagtcacccttaaacacacacaggtaccagttcctataagaggaggtaggtaagggagctgaggcaaagagagtgctttggatgtataggatcttcataacttgaggacatcctatacccagtaaatattaaatgttaacagtaaaaccttgggtggtgttgccagttatcctgcattcctatcagttccttgttaccaacttttttttcaggaatgaatgtgttcacagtaagaaagaaatattatagtgctacatgttacatgcaaagaacgataacaccataacaccataatgctaactaacggtgggcatttgttttcaaagttcttttaaaaagttactgtttcaaacaatgaaaagcagtatttttatgcccttcattttaagctttgacataattgattacggcatggtagccaggtcagaaaatgaccttgcttctgaaaaagctggaatcccagacactgttcactgcatttcaaagagttatggtctttgttcctaagggaaaccccctcaggatatgagccattgctgatttgggtttcagtgccgtgtcaaaaagtcttaatcccagatttttttttttcctacaattgttttatagattgttgtcagttgcttagttaggccacagtactgtattgtgttttgtttttattttagtataactgattcatttttttggccacaagcctctaactagaaacacaatgtttctttttctctttcccttcaaatgtgttttgtagcagtcacagagagtgactgctttgtcactctttgtgactacctacctaatcaaacctctattggctttcaaactaatgggaaaaatgtattcctaatagctgggtaattacaaaaaaattaaatgattagtaattactgtttaagatgtaaataagattgaacaatttgtaataatagtaaagggcttaaacttgatctacatagtgtgttctgtaggtaagcattctagataattgaagatttttgtagaatatatatatcaagtcattgatatatatttctttcttttttttttttttttgagacagagtcttgttctgtcaccaggctggagtgcagtggcacaatctcggcttactgcaacctccacctcccgggttcaagcgattctcttgcctcagcctccggagtagctggcatgccaccaagcccagctaatttttgtatttttagtagagatggggtttcaccatgttggccgggatggtctcaatctcttgacctcgtgatcctcccacctcggcctctcaaagtgctgggattacaggcatgagccactgtacctggcctgatatatatttcattagaaaaagaatgtagaagtagaaattcaagtacataaagcatagaaattaaatttagaaaataaagtacttaatggcagattttactgaaatatatttgagtttttgttattcatgatattgtaggaaaacatgaataattaaaagctgtcagttacacaacaatctcaggtcagtcattagtttaccatcaaaacttttatcaaagataataacagtaggttttctttaattttaaaaaataaatagtttggtttgagttttgttcctctgctcatctttggtgatgagcagtgaactcaaaagaaggaaaacaagaaatcttgaagtctgagtagttcactaatagaatttatcaatttaaatttttaaaaaggggggctcacgacaggtgctttagaatgctagtttttatttagaagttactggcatttacttttaaaaattagtaccccaccaggtgtggtggctcatgcctgtaatcccagctacccaggaggttgaagcaggaagaccctttgaggccaggtacttgagaccacgctggccaacatagtgaaaccctgtctctaacattttttttttaaacttaaccaggcatggtggtacttgcctgtagtcccagctaggtgggcgtagagggggattactggagcccaagaattcaaggctatagtgagccataatcacaccactgcattccagcctgggcaacagagtgagaccccgactcttaaaacacacacagctgggcgcggtggctcatgcctgtaatcccagcactttgggaggccgaggcgggcagatcatgaggtcaggagatcaagaccatcctggccaacatggtgaaacctcatctctactaaagatacaaaaaattagctgggcatggtggtacacgcctgtagtcacaaactagctaaaaatgacttaaaagcatcttgatcagcaacagctaccaaataacccagcttttaacaaaaatgatttctataggttgtagaaagaatgtttggcctttagattaattcattttaatttgagaaaactgtttagaaaactaataggaagtgttatctttcttttgtagcccttgaataaacaggaagagaacagtaaagactggatagttgtatgggtctttatttttaaaaagccatatgtctttctttttttatatttatttgacaaacttttttaactcttaaaaacttcagaattcatataactaaaatagttttaaattttaaatatgtttacctgttttgctcaaagtaaggattggccaggtacagaagctcatgcccagtgccatgagaggctgaggtggacggatcacttgaagccaggagtttgagaccagcctgggcaatgtagcaagacctcatctctacaaaaagtttttaaaaattatctgggcatgatggcacatgcctgtagtcctagctatttgggaggctgaggcaggggaatcgcttgaacccaggaggtggagattgcagtgagccgagatcgcaccactgcactccagcctggcgacagagcgagactccgtctaaaacaaacaaaaaagaaaaaaccaccaccacacacagattagtactccatttaatgttttaggtaacttacaaaaccatattaatatggccaggcatggtgtatcacacctgtaatcccagcactttgggaggccgaggcaggtggatcgcttgaggtcaggagttccagatcagcctggccaacatggtgaaactccatctctactaaaaatacagaaagttagccgggcatggtagcacacaggagctcctccagctactcggtagactgatgcaggagaatcccttgaacccgggaaacagaggttgcagtgagccaagatcacaccactgcactccagcctgggcgacagagtgagactccatctcaaaaccaaaaaaaaaatcttagcactttagcttgataaagcttctgtaatacggcctgtagcccaacatcttgtttactttttcaaaagtaacagtgatctagcatgattgcattagatattgatttctctaggcaggcataaatttagttatctgtttctgtcttgattttactggaaattactttaagtcattaatagatttgacttttattctaacctactttaacaaattgggacatggtgatatagctgccttaccttggtgttattgttttactgcaggtatttattgaatggttgtgaatgtgcagaatagaatgtttttagtttggaatccttgagtaggcccaggaaagtggttttctgtttatgtcagtaaatacattatcaagctgttcttttaggaatatggcataaagctgcactacatacatcatttttgaaaaatcaggttgtcattttagataagatataattgtaagaaggtccacttgaagttttgtaattaccctgtatgtgaacagatgtatatttcacaacaaagtttcctttgatttcattaaagatcatttacaaatattgccacaaaacctttcaaaaaacatagggccattgtgccaaattttctcactatttctattaatatcattgataaaataattattagttaattttagatgtaatctgctatgctttcatagtatttaaaatttaaatgtcctttcaaaaggtaataaaagtaataattcacatcttgaagattcagttaatatcctattggataattgtcataactattctcagctttttgtgaatgttgttaataaaccagtattgctttgcatccaaggaaattcgagtgatttctattttctgctgcctagttacctgagattttgggatgtactaggaaaatcagactaatttatgattgcctagcacttatttttttcctgctgtttttagacttttcaggtttagttggtattatcacttttggtagtagtcaacttaaaattattagtagtcaacttaaaataggactgtgagaatgagagtggtactgttacaaattatttaggtttgaaaggccagcagatgatttttctcttagatgccatttcttcaatttgagtagcactgtctttaggttgaaggtgcttatatacatttcaactccagtgtacagtattacataccacattttaaaagctgtgcacttaaagcaagatttaagaacaaaggagaacagtctcttgttctctaaacttgaagtgtttttaatttttggttcaacctagggttagttttgtttgtttttatttttgttttttgcttcattttttgttgtcatcatttttctgcctggcctcagtgggcccaagaaagagttcttgttaagtgtttcctgaggaccagacacgtgattccctgtttagacttagcacttcagtgtcggtcttagtttgctatcaaatcttactgtttcaacttgctggactttagaaatcaaaactctttaattagttgcttactttaatgactggctaagtccttatctatgctcataccctgttcacctcaaggaccttagaatcctagcgccttctttgtacaggcaagctattctttgctttgcttgattcagttccttggtgcactgcttaagctcatcttacttttatattttctttataacaaaggatagagggggataaaaacaaaatcaagctgtagggtaatttcctggtgaaccttttgtagtcactttcatgtaagaaaaatgtttcccaagcaaccagctttattctagctgactcactttgtactccctccttccatgtcattgctcctttttacctctttaggagtctgttaggaattttgcaacctgacaaaaggcttctgcagagccaaccacctttttttttcctcagggcctgaaaaaaaagtgagtcttcctactgacaggaaaataaaaagagaccttgttagtcaatttttttctgtatgttcaattgttctggtatattcttttccttgagtataaagaaaagtctgaaaataatggtaaaagtgtgagattgctctgatatttcctttttgtactttaggaggtggttctttgagttcctagttgtttagttgaacatgaagcaggtggcaaatgtaagtttagtctacacactgattccttcctgttcgcagaagggttcatgtgttcgtttttaaataatcttcgggtaaggaatagagaaacaccaagcccaagaggcagaaggatctgtctatagctaatgagtgagaaactaactgtgggatggtttatggtctctggctctttgaaaccacagaaatttaaagttatttttaaaaagccaacttgactgggcacagtggctcatgcctgtaatcccgaggcaggcggggggccaaggcagacagatttcttgagcccaagagttcaagaacagcctgggcaatatggtgaaaccccatcttctcaaaaaaattaaaaaattaaaaaaaaattagccatatgtggtggtgcatgcctgtagtcccagctactctggaggctaaggtgggaggatcacttgagcctgagaggcgaaggttgcaatgacctgagatcatgccacactgcactacagtctgggaaacagagaccttgtctcaaaaaaaaataataactacacctaagcacttacaccattattttaagtcctgattactttaaggccataccacatgagtgctgaagatctgagtttaaaattggaaaaggtgttcctataattgcctggagaaaaaccaataattgcccagagaaaaaccacttgcagaagctatgaaaaaccaagttagattcctactagtcagccacgtcagtagctgatttcaaaatatgagttttgcagtaagccaggcaagacagtacaagtagcttctatttggggaatctaatctatataggttcttaatacatacttgcattgattgccattcaaatctaggagctattagtgcttcagctgtgggaaaattgtgagattatgcattgacagaattgagaagcaaattctacttcacgttgcagaaggctcatcagattttagattgatatagaaataatataacgaatatttctactacgctttttgtaaagtgaggagactgttctaaagtgactttgtatatgtaataactgaatccctttttaatgacaaaataattttaattgatatttatctagaaagttggttgttgatggttatttgacctatacaggttaacctcattttgaacatgttgactgaggacagtttcagtgattataagtcaaatcacatatctagagattttgtcaatgtattacagtagccatcttggttttgtggggcaatctaagccaaaaaataatgaagctgtttatataccttcctgctttttgctgagcatttttgataaatgtacataataccatacatgtagtatttgcatttaagcctattcagtgcatgcactgtctggaagagctctgactaaatagacacgtgcaaattttttccccattcagtgaacactattaaaaaatcagatgaatatttatacagtggcattggccatgcaattcttcctgctttgtccctttatcacacactaacagaacgtaggattaattatccacctaattaacttgggggtggggtagagttgctggataaagtacaagacactcagttcaattccaatttcagataaacatactaaaaatgtattcattgtttatctgaaattggaattgaactgggcatcctttatttttagttgctaaatctggcaaccctaggtggggaagaggcaggagactagtagatataggcacagttgtgagatttaaatacaccatgcaatgacaagagtaacctttactctcacgggaatactaagtgttttttagcgcaatgctatttattttagtgtccaatgcttttttctttttttttgaaaatgcatcaatgctcaaagctcaaaaatagtaaaacgtggctcacacttataatcccagcactttgggaggcagagaggcaggcagatcacctgaggtcaggagttcaagaccagtctggtcaacatggtgaaaccctgtctctactaaaaaaaaatacaaaagttagccgggcgtggtggcaggcacttgcaatcccagctacttcggaggctgaggcaggagaattgcttgaaccgggaggtggaggttgcagtgagccaagatcgtgccgttgtactccagcctgggagataagagtgaaactccgtctcaaaaaaaaaaaaaaaaagggagaaaaaagaaaaaaatagaaaaatgtaacaacatattgtttagggatacatgcacgtatgatgaactgtttttgaaaacaaaaaattaagggaacaataagcgaaatctgggatagtggttacctctaagggagcagcaagcagatggaataaagcacatagtagctgcactggtattaatgctaattctcagttaatgtggtaagtgacaggatgtatttttttatgcttcataattacgtgtacacattgcacatatcaaatacagaatagcattttaaaagataagttaaaacagacttcaataagaaaattagcctatgtgcaaaatttaactgtatatactttctaaaataaatccaaaatccaaaaagtaaggtcaaaaggcattctgaaattttaccagtttgctaaagatcatattgagtaattaatagattctagaatgattacttatctgctgtaatacatctaaaataattaaactctttggtttgtgaaaatttcatttttattacttgatgtctacagtggtgaatcttcagtttttgtctttacttggaaagattactgattgttcagatatattatatgccaaattaaaggaaagaaaaacagcaggtagagcatgcattaagtgattaattcaaatgagctaggcctaaactttaggattcctggaacaaaaaatcagaaatctctgttttccttgattaatttttaaaagttagatttctaactcctcgtttgtaaaaactattatgacagtctacaatatccatcagtaagcagaaaaattcatctttagcaagtgccagtttagagcattaagctgaagttagtgtttagtgtaaatttatttagtgttttaaagcacttctagctctctgtagtcttatataattttgtcttgtagaaatagctggagggtctattccagaaagcctatccaaatatgtcctcttctcccacttacatacacacttaggtgcccctcctctgtgcttcaaggttatcatgtgcttgtgtctctcattgcaattgttaccttatattgaaattatgtgttatattttcctcagcttatcagattgtgacctttctgtgggcaagggctggatctttctcaccctttgtatttcaatgcctgaaagtgcctggcacatggtagataaccaataaggatttgttgactgaatgaaggggcctaaagactcaactaatacagctccttcattttacaggtgtggaaactgaggtttaaagagattgtggctttagaaatagaaacaagaccacagagattgtctgttccagccttctacaatatccctattgagacatcattgagtttctgttttaatactttatcagggaagcagctcatggctttttctaaactcaggttgttactgagattgttaggttgaacaaaagcctatctctttgtaatttctactcttagtcctagttctgctgcataatgcttcaaacatttgaaaacaactacttttcttccttatcttcttctggttagccatccttagttctttatatcattccactcagtttctagaacattcaccaaattgatttctctcttctgagtatgttctgtttcatcagtgttccttttaaaatgaatctcaaaaagtatatgatgttcctaaatgtgcttttatcagtaagaagtagaagagaacttaccattccccttgctctggacatgatagttctgataattcagcctaaaaacacagtagttttggcagccatatcacagtctttgtctgagcaatcaaccaaaatacctaaatgttttcacatgatttgctgttaagccatgtctctcccatcgtgcattttacatttatccctactacatttcataccgttaagatttgacccattgttctagcccattgaaatattttggtggccagtggcagtggctcacacctgtaatcccagcactttgggaggctgaggcagaaagattgcttgagcctgggaggtcgaggctgcagtgaaccatgatcgtgccactgcactccagcctaagcagcagagcaagaccctgtctccaaaaaaaaaagaaaaaagaaaaaagaaaaattttggggtcctgtcagccagtatattacctgtctctctcaactttgtgttatctgcaaatttagtagatatgccatcagtatccttatccaagatattagtaagaacatcaggtagggtagaaagtaatttagtgcttaaaaccggatttttgtgtgtgtgcaatattctcttttattctaggccagtaaccctatcagaagaggaaattaggttaatcttgcatgattggcttctgtgaatgcttgctgactcttaatgagtatctttttcccttgcatagggctcttaaacaattaaacagtgtttaagaaatttgtttggaattgacatcaaatcaatctgtctgtagttggtggcatctaggcatctacctgctttgcagagttgactattagtgttttctttacatcatccccttccattcccctgattcttcaaaggttttagatggaaattgagctctgcaaattctcagatacactgggacataatttgggagagtagaatggaagtcacttataatattaatagttaggtacttttatctccttgaatgctttgggattcagtttcctcattctacaatttgtttttccctttctggtttgactatcagtaatcttaatagaaaaaaaagttgagatagccttttacattataataacgtatacttatccatatataagtagacctgcactttatatttgttgtgcttgttctgagtataaattaagaaaaatcttgtctccggtattttttttaaatcttagcacattctgagtgccagcctttctgataatgttcttacaggtttttgcaatttttcttggatatgtgcccattccatccctccaatctctcctgcatgtttttaaaaaaatatttcttctgacatgtcaccatgaagatgcaatcaacaaaattcagacatgagaaattctacaggatgagcaacctactttcttcaacacatgaattgcaagaaataagagagattgaaggggaacctgctgatttatcgaaagagacatatcaactgattgtaatatatggaccgtatttgattgatataaaccaaacgtacaaaaatttgggcagtctgggaagtctgaatgttatataacagcatgttatatataatatatataatctattaatgtatataataaggaattgttaaattttatagtagtgttgtggttatgttttaaagagaaatctttgtcctttttagatgcatactgaaatatttatggttaaaaatgaaatggtttcggccgggcgcagtggctcacgcctgtaatcccagcactttgggagaccgaggcgggcagatgacgaggtcaggagatggagaccacggtgaaaccccgtctctactaaaaatgcaaaaaaattagctgggcgcagtggcgggcgcccgtagtcccagctactcaggaggctgaggcaggagaatggcgtgaacctggaaggcggagcttgcggtaagccgagatcacgccactgcaccccagcctgggcaacagagcaagactccgtctcaaaaaaaaaaaaaaatgaaatggtttctgggatttgcttcaaaataatctggcagaggggtggaagaggagtactgatatttttatcattgttgaacatgatcaacatgttgtatatttgggtttataatattattctcccaattttgtatatatttgaaatagccataagtaaatgttggaaaaactccccctaaatatttattgtcacatagatttttactggcagatttgggactaaaactcaggtctcctgattctgctctttttttgtgtgtgtgtagctaaaattatagctcttgtactttcagattgatgtcatgttgtcctttcagtctctgggacccccaagctttccctgagaaatttgtggtagtacttgtagataaattaaggccttactaaagggtcacagtttcacttgactggctacctacctatgtgaaaccataagggacattagacttactagtgtagagaggctgcatgggttattagaaccagcaaagaaacttgggtcctagtcttcactaggccttagcataagttctaagatggcagggaccatgtctgttttgttcactactttatactcaatacctgggaccatgccaggtacatggaaacaatcagtaaatgttgaattaatggattaatttaaccgatggcataatttccctcacatgtaaaatgagacagttgatctaaatgattcttaagtttccttcaaacactgaaaaaaaaagtactcttgccttctgactgatttttttaaaatccttttaggattttgaaaaggattactgtaaatttctttaacactaggtgacatcagtaggtaatatgctcactttgaataactgttatagaaaaaccacagttgctatattgcatcaaaatctctttaaaaatagactactgttatatattttctgttagattggtatttatttctataaagtacatgcatactgttctcaacatactaaattagagagtcaggtttagcaagttccaaagtgtagccatctaagaaggttactaaaatgttccctttgcttgcatacttgtgctttttgcttcagttgtattgaatgcagtactattatgtcagagtttataaaggatttgacattttgcttcccaaggaaaaatcagtgggcaacttttggttaagtggcagttattgtcatcgcatcagtgactaggctcctatcattgggagtaatgaccttattatgaaattttgcttcaggtatctgtaggttatcgctgaatcaggtcagagtttgtaaaagaaaactaattcctataccgttttataaaatcaccagaacagtgttttgaagccacatacatgttttgaaatagtgactatatatatatatatatatatacttcttgaggacctttccgcattcctccagctccttctgaagccttgtcttggctgatacatggatgttgatgacctctcttgttgcttctcccagcagtgtttaccaagggcctttgggaaaggtttgcatgacatcacagggcagctagaggggagaagtgttgggagactggaaaggcctctgtgtgatgccactaatcatatgaagtagcaatccacatactcttccttttttttttttttttttttttggagacagaatcttgctctgtcacccaggctggagtgcagcggtggatctcggctcactgcaacctctgcctcccgggttcaagcgacactcctgcctcaccctcctgagtagctgggactacgggtgtgcaccaccacacctggctaattttttttttctttttgtatttttagtagagatgggatttcgccacattggccaggctggtctcaaactcctgacctcagacaatccacccaccttggcctcccaaagtgctgggattacaggcatgagccaccatgcctggccaaaaataatttctataattaaaatgctaaatgaatagggactggagaaagcatgtaataaactattttatattcagacatgagctttgttaatataaactaaatgttagctagtgtactagtgtatgaaaataactttcttttttattttattttattttttgagacagagtctcactctttcacccaggcgggagtgcagtggccctatctcggctcactgcaagctccgcctcccgggttcacgccattctcctgcctcagcctcccgactagctgggactataggcacccgccaccatgcccggctaattttttgtgtttttggtagagacggggtttcactgtgttagccagggtggtctcgatctcctgacctcgtgatccgcccgcctcggcctcccaaagtgctgggattacaggtgtgagccaccacgcccggcctttttttttttttttttgaaatggagtcttgctctgtcacccaggctggagtgcagtggcgggatctcggctcactgcaagctccgcctcccaggttcacgccattctcctgctcagcctcccgagtagctggggctacaggcgcccaccaccacgcctgactaattttttgtatttttagtagagatggggtttcaccgtgttagccaggatggtctcaatctcctgaccttgtgatctgcccgcctcggccaccaaagtgctgggattacaggtgtgggctaccacgtccagccgaaaataactttctaatagaaaacaggatataatgcattaaaatgttctatttatattgaaagttgctgaagtactaatcttaaaattgcctttatattcaaaacctaagtggaagacacactaaataattttagtatttgatctgtaagccatgtgggttttttagtagaatatcagtacttatttgaatcagaatttattttgaagctgtttcagacgttgctttttgtgtttaaattcattggcagcattgatagacactgtcttcaatttcagaaactatgctgcaaaatcaaaattttgctgtttttgacattagtctaggcaatgatattttggatttaaccccaaaagcacaggcaacaaaagcaaaaatacacaaatgagattgtgtcagactaaaattggtctgataaaattgcacagcaaaggaaacaacagtgaaaagacaacctacagattgggagaaaatatttgcaaaacatatggtttagatgttttgtgccctccaattcttatgttgaaatgtgaccttcagtattggaggtaggcctagtgggaggtgtttcagtcatggggcagatccctcatgaatgtcttggtgctgtcctcacgatgaatgacttcttggcctgagttcacgcaagatctggttgtttaaaagtgggtggcatctcctcccccactttcttcctgtcttgctatgtgatgcatcccttttgcattccatgattggaagcttcctgaggccctcaccgggagcagatgctggtaccattcttcttgtacagcctgcaaaaccatgagctaaaataataaacctcttttttttttttagacagagtctcgctctgtcgccaggctggagtgcagtggcgcaatgtcggctcactaaaacctccaatttcctggtttaaggaattctcctgccttagcctccctgagtagctgggattacaggcacgcagcagcacaccagctaatttttgtatttttagtagagatgagttttcaccatattggccaggatggtcttgatctcctgacctcgtgatccacccgccccatcctcccaaagtgctgggattacaggcatgagccaccgtgcccagcctaaacctctttttttttttttaataaattactcagccttaggtatttctttatagcaatgcaaatggactaacacaccatacatctgataagggattaatacccacagtatgtaaggaattcaaacaactcagtagccagaaaacaacccaatttaaaaatgggcagaggacctgaacagacatttctgaaaggaagacatacagacagatggccaacacacagtggaacactattgagccttaagaatggaatcatgtcatatgtggcaatatggataaacctagaagacattatgttaagtgaaataaaccaggcataggaagactactactgtataatctcacttgtatgtggaatgtaaaaatgatgaactcgtagaagcagagagtagaatggtagtttccgggggttgggggagtagggagcagctgaggaatgggaaaatattagtcagagggtacaaagttttagttaggaggaataagttctggagaactattgcacagcatgatgactataataataacaatgtatgtttcaaaattgctgagagagtaaattttgaatgttctcaccacaaaagatcagtatgtaaagtgaagaatatattaatttgcttgatttaaagatttaccatatttgtaattagtattaatatgttggaagtttgagttttgttttgtttctgctgttaggtgagcaaggaagcctagctcttgaaatttgtatttttgttcaactttgtaagaagcatatttattatttaaataaatatttattgatcagatagtaaatgcatcagaaatatttgatttaaaggtgccctatgatgaaagctttggaaagaaaaaatgaacttttgaagctctcattttggtttgtcgggttttctttaaaaacataccaccaatactcaaatatgtctacatgtaacttcagagttttctgaaaaattttccgtgtgtgtggtttaataaagttattttatgtagacatttgaactttttctgcaaaaaattaccttaatatgtaaaaaggataaatccaatttaccccatttagtatctatagaatattttgaagaaatatttttctatttttctttttttatttcttttttttttttttagctcctgctatcactggagaaaaaaatatttttctagttaactagatgtagcaaagtattattggacatttctgggtatgtacgtgtatgtctgattatatccgtgttttatataatatatttcaaatttaagggaaattagaggatataatatttagatcattaatcatggtacaaattatgtctccactctcaaactaatggtcttaagacaaaattccctaaaattataggaactctaaaatcccttgcttaagatatttctgctagttagtgggagagctaagagtagaacttaattttcttgacatctagttccccatttctccctcccatccccaaacttgaacatgaatagttgttttctttaggcacataaacactgaaatagtctactgttactatctctactttgacattagagacttatttacagagaatttttgagttgtctaaggatactgaagattaataacacctcacttatctgttggccacctctgtggtaatgacagttctcaagatacagctgaaaacaagaaataagcatttaaaaagcctctgaacagttcaataaaaaaaaaagtgccacaaagttcaaaataagattatgtacgtaaagtctcatggggagacccttaggatccctagattctcccttcaccatacaatttcatattaaggaaatctggtttcccagctcaatgcagattagaagcacaagtgagaaggatggtgggaagaaagcttttaaatgcaggcgcatggctgactgtaataagccaccgcttataggctgggtgcggtggctcacgcctgtaatcccagcactttgagaggctgaggagggcggatcgtctgaggtcaggaggttgagaccagcctggccaatgtggcgaaaccccatctctactaaaaatacaaaaataagccgggcttgggggcgggcacctgtaatcccagctacttgggaggctgagtcaggagaatagcttgaacctgggaggcgggggttgcagtgagccaagatcatgccactgcactccagcctggccaacaagagcaaaactccgtctcaaaaaataaaacaacaacaacaacaacaacaaaaagaagtgaccacttaaagtgaggaaggaaatataaaactataaaacacagacattccaggcatagtaacttagggtccttgaaggcaaataaatctgcactttagggtccctaaagtgtattaaaatataatgtagtatttgagcgtgataattaagaaggacaattgtatatcctttgtttaagaagatattttcagggaaagagtactgaaactgcaaggtttaacctactcatgtacttatttacaagctgcttttgagatttttaaattcaaaaatagttaaaatattatcaaaaatttggcactcaaaagcttcatctctctggaaattttacatgtggaacgtttcattatttcattccctagcagtccaaggcaattaggtgttaattgtagttgttaaaggcaggtcaggattcagagcctttgacttaatcagtttagtccaattcaagaagcagcgttaattgcctttactttggtgctcatacacagcaccagttacagtgttttcataattatcttcttttaagtccttacccagagaggaggcagtattgcgaagtggttgagagaatgggctctggagtcaggctgcctagggtcaaattctggccctactgtttactagctgtacaatgtaaatgacctaatctgactcaagccagttttttgttatgtaaaatagagcaagtaatataaccacctaataggagggctgtgaggaccaaagaagctaaaacatgtcaagtgttatagtttttggcaaatgcttaataaatgatggccattgttttattttattttattttattttattttttcattatactttaagttctgggatacaggtgcagaacgtgcaggtttgttacgtagatatacatgtgtcacagtggtttgctgcacccatcaatccgtcatctacattaggtatttctcctaatgctatccctcccctagccccccaccccctgacaggccctggtgtgtgttgttcccctccctgtgcccatatgttctcattgttcagctcccacttatgagtgagaatatgcggtgctttattatttttacaaggcccctattaggaaagttttgtgtgataatactaaataatgttttttattgcttcttagggtgaaatgaattggttttttttcatcttggcacatgatacaaatcattttagccaactttgcaagttataaatatgccttcactttttactaggcattaatgttctacaaatggatttagaaatttgtcacaaaggaattctactcttacagattaccctgttaaagacagttttaggcttaatagacttgaaattgtagtagtttgaaatgttcctacctaccaaggccttaacaactttgtaacatttaacatatacctcaaacatgagtgtcttttgttactagttttttatttagtgatgtcacccagttgcaagcaggatcccattttaatcaccagctcaatatgatatagctttttcatgttccctgtcgttaaatgtgctggaacttgacaggctataggggacctttgctgtattccagaaattggtctcaggctccccactactgacagactgccaaagtgcctttgagaaacttggagcatttcagagctgctgaagagactacactatcatgtgtgtcccatgtactcactcacttcatcctcatagaagttctatgaaatagatggttttacccccttttgcagaggatgagatcgaggcttggagaaatgatttgatcacacataggataaatagtagaaacaatattgaagcaaggttcatctgctcaaaagcctatattttactgtctcctcgtctctcaaaagaaaataataaattactctgtatagtttgtacacagttatatgtaaagccccaccagaaccaatctagaatatttccatatatttccatgtgtgtcagtaattagccaataactttgatcctatgaatcaacagccagagagtactgtttttgaaactagtggcacacaagaaataaatatggcttcctggtttttttttgtttgtttattttgttttttgacagctaaaaaacctgttcagatatctcaaggtgtgagggttgctggaaaggccaagtttcttcccttctctacctcatatggggcttaattttaaaatatcttacccttcttacctttatgcctttgttgcaggtgattggcatcctgaattttgtaccacatggaaatttgtgccccttaaaggtttttcaggctaggtgcagtagctcacccctgtaatcccagcactttgggaggctgaggtgggaggatcgcttgaagctaggagttcaagaccagcctgggcagtaaagtgagaccccatctcaaaaaaaaaaaaaaaaacaaacaggtttttcatttttgctttttaatatttgttgttgttttgattgcacttgtattatttaagatatcaatttgtgtggaatcttctttctttttttgagtatggattagcctcagtcctaactaatcaactctagataaacaggattttgatacattgcagtgtaagtttgtcaggggaccaaaataattagcaatatatgttttcatttctggaaattgtcctttgttaacacatatttatattgaccagacattgtaattaaatgggtactattttatgacaactactttttttgttttctaaacaaatttaactccctcccctaaactagaattttatctaatttatctttgtatctctagtcttggtacatagtaggtaattcataaatgtcagctttgggtgtctggttttattttttgttttgagacaaggtctcgctctgtcacccaggttagagtgcagtagcacaatcatggctcatggctcctgggctcaagtgatcttcctacatcagcctcctaagtagctaagactgcaggtgtgcaaccccatgcctggctggtttatttttattttgtagagatggggtgtcactatattgcctaggctggtctcaaactcctgagatcaagcaatcctcccgccttggcctcccaaagtgctgggattacaggtatgagccactgcacccagcccataaatgtttgttgagtaaagggattgattttctgttactcaaaagtaatttttttaacaaattaagtttttattagaggtcaaggattcctctaccaaaggaatcattacccagtttggcatataaaaacatgttagtaggactcatttcttctcttggttgtgctccaaaatacgactttgaggaaaagtcacttaatctcttggaatctcagtttcttgatctgtaaaaagaggctgtgtgattagatcatcttgaaggtgcctttcaattcaaatttgcatcatgtaatcattggattttaccaaaaaaaaattagaaatggcatattaattatttaaaactttcctattgcataaccccaaggtataactaagtagccttatgctttgaagcagatatcagactgttcctattcaaaaaaaaaatgtgggggaaagggtgaaatggtgaaaagttacttttaaaaattattacatccaggctgggtgcggtggctccctcctgtaatctcagcactttgggaagatgaggcgggtggattgcttgagcccaggagttcgagaccacctttagcaatatggcaaaccccgtctctatacaaaagtacagaaatcagctgagcatggtggcacgtgcctgtagtcccagtacttgggaggctgaggtgggaggattgcttgagcccaagaggttgaggctgcagtgagccatgatggtgtcactgcactcaagcctgagtaacggagtgagaccctatctcaaaaaaatatgtattacatccagagtagtctgtttaagaacagagtcttgctccagtagaaaaatgagctgagagtggtacacagtggttcgttcctgtaatctcagtactttgagagactgaaatgggaggattgcttgagcccaagagttcaagaccagcctgggcaacatagtgagaccctgtctctacaaaaaaatacaaaatattagctgggtgtggtggcgcatgcctgtagtcccagctactcagaagactgagactggaggatcgcttgagaccaggaggtcgaggctgcagtgagccaagatcacaccactgcactccagcctgggcaacagcaagactctgtctttaaaaaaaaaagaaaaagtaaaagctgagaacaaaaatgggtatctctcttcaaaatcgatataaatgtctaatacatatgaaaattttcatccacactggaaatcaaagtacaaattaaaacaccaatgagatatacttttgcctgtcaacttggtaaaaaaaagtttaaaataacacttatttttggtgagggtattaagaaacaggcattcacagagcagtaggagtgtaaacaggtacaagttggcagtttgaaagtagtgttatgtcatatacaactatatatgtacatatgaagataaaagatactcagatctctaggtgataagattatgtatgaatcactttaattttcttctctctcttttttttttttttttttttaagagatgggatcttgctgtctcccccaagctggagtgcagtggcacaatcatggctcactgcatccttgaattcctgggctaaagcaatccttgtgcctcagcctcctaggtagctgggtctacaggcaatagccaccacacctggataatttttaaattatttgtagagacagggtctcactccgttgaccagactggtcttctccactttttttttctttttctttttgagatggagtctcgctctgtcaccagggctggggtgcagtggcatgatctcggctcactgaaacctccgcctcccggttcaagtgattctcctgcctcagcctctcaagtagctgggattataggcacgcaccaccacaccctgctaatttttgtattttctgtggaggtggggtttcgccatattcaggctgatcttgaactcctgacctcaggtgatccgcctgcctcagcctcccaaagtgctgggattacaggcgtgagccactgcgcccagcctctcttccactttttgttttccacattttctacgtgcacacaagacttttcagtcacaaaatatatacacattttttaaatgtggacttgtctgtagtaagtgtatagaagtatttgtcttctcatctcctctattcaacacctccttacttttatttctgaacaggtctccaggaaaagttgggctttcaacattcaaggtaagttgtgctttctgaaagttatgtttttagaaattgtatactttttattcgtgtttttgtgtaattcttcattttcttgcttttgcttttttttacttactttttgctcagtaatgtagtcattatgtcctacttggtatacataggtactctagaaatacctaactaaatattatgctgtaaagaaggaactgtaagtattttttagatttctactgatttttatttgtttataatatctagaataaaagaacgtgtgtgtgtgtgtgtgtgtgtgtgttgaaaaagtgatacttggccaggcatggtggctcacacctgtaatctcaacacattggggggctgaggtgggcagatcagttgaggtcaggagtttgacaccagcctggccaacatggtgaaaccccgtctctactaaaaaaaaaaaaacacacaaaaattatccaggtgtggtggcgcagacctgtattcccagctacttgggagactgaggcaggagaattgcttgaacccaggaaatggaggctgcagtgaactgagatcgtgccactgcactccagcctgggtgacagagcgagactccacctcaaaaaaaaaagcaaaaaattaatacttgcatgacaaaaatgtacagtaactgaaacacatgtatacttcttgtgggcccatgtaccatcactatatataaaaatcaatcccagcttatattcaggcagaggagtttggtattgagatattatgccactgagagccattttaagtataagatatcaccaaatggaactatttatatcagatagagtatatattgtatatgtatatttatatgtatgtgtaatctcaaacatgctatatttttttcagttccagtataccgaccttctgtttatacacattggataccagtctctttgataaattatgatatgtttatatgaaatattctacagtagtagaaatgaatgaattagttatatacaatgacatggatgaatttcagcactagagtgttgagttgggggtaactactcatagaaaaacatatacagtaacgtttcatttatattaagttcaaaagcatgccaaactaaagaatatattgtttagagaatagattgtttagagatacaagcgtggtaaaactgtgaagaattaccagggaatgagaaatacaaaatttaggatatcggtcattctctgagggggagagattgtaatggaaatggagaaggatacacaagagacttgaaaactgataataatgttctttttcttaaattgagtgcttaagaaaagttatatcataactcttacgctaaataaaaattattttgtatttacttaatatttaataaaaacagtctttaaaagtaataacgtgtagggttgaaatttactcaggacaaaaggtatatggttgaaaatgtagctttccttccacttctcatcccccacctctcaaacttcatatccagaggcgattactgtttatgcttataggtcttaaaagccatttagcgctaagatatttttatattataacaaatagatttggagaatttactttaccccgtaattatagattgtccttaacttgagtgaaattagataacaagtatacatatttagtaaataaatatgaagttggatattgttcatttttttaactttttattttgaaataattatagattcacaggaagctttaaagataatgcagaaaggtcctgtatattcttcaccatttccccagtggttatatcttaattatagtacaattttaaaatgaggaatttaacgttggtgcaatgcgagtgtatagttctgcgccaatttatcatgtgtatatttgtataaccaccacaatgaagatgcagaactatttcatcatcacaaagatctccgttgtgctacccctttataatcacacccaccaccttccccatatcatccctaaatctgttttccatctctataattttgtcacttaaggaatgttctataaatggaattatatactatgtgaccttatgggattggttgaaagggtcacgatccatccaagttgttgtctgtatcaatggtttgtttctttttattgctgagtagtattatatgataaacatgtactgaggctattgagtgcatattatgaataacagtatatctattgatattgtaatataaaggaaggcttgatatagttctgattgttggtgattttacagtctgatggaagagacatgtatacaaaagggcaatttatgaggtctcgatgtttgtaaaatagaatagacgtgttaactgccacaaggggtttggaggaacgagaggaagatagaattggcgtgagagcactgttacctgaaatagcagagaaaagtttcagggaggaaatagaacttttgctgagctttgaaaattgggagaggtttgcataggtagatagagaaaaattgggaaagcattgtagttaggaaatagtagggactaataaatatgcaaaagcatgggatttgctagaagcattgaaaaactgtgaccagtgtaaaagtttcagtggtagagtactggaaaataaattgaggccagattgtgatgagccttgaatgtcaggttacctgattttatcataatactatgtatacatgcattgaaacatcacattataccctgtaaatatgtatcatattatgtgtcaattaaaaattaaattataatttagaaaagagatggggcgcagtggctcacgcttgtaatcccagcactttgggaggctgagacgggcagatcacctgaggtcaggagttagagaccagcctggccaacatggtgaaactccatctttactgaaaatacaaaaattagccaggcgtggtggcacatgcctgtaatcccagctacttgggaggctgaggcaggagaatcacttgaatctgagaggctgaggttgcagtgagtcaagattgtgccactgtactccaccctggacgatagagtgagactctgtctcaagttaaaaaaaaatttagaaaagaactctgatctttaaaattttgaagcaggatatttttgggtttcttttccttgcttttcttttcttttctttcgttctttcttcttttttttttttttttgatggagtctcactctgtcacccaggctggagtgcagtgatgcaatcttggctcactgcaacctccgcctcctgggttcaagcaattttcctgcctcagcctcccaagtagctaggattataggcgcccgccaccacacccagctaatttttgtatttttagtagagatggggtttcaccatgttggccacactggtctcaaatgacctcaagtgatctgcccacctcaacatcccaaagtgctgggattataggcatgagccactgggcccgaccagtatatttttgttttttgaaggtctcactctgtcacccaggcaagaatgcaatggcacaatcacagctcactataacctcgaactcctggtctcaaggactcctcccacctgagactcccaagtagctaggactacagactcaaaccccacacccagctattttattttatttttattttttagagatagggtcttgctaggttgtccagactggtctgaaactcctggcctcaaaccatcctcctcccttggcctcccaaagcattgggattacatgaatgagtctctgtgccaggcctaaagtgggacatttaaaaagtcaacttttatatgtcttacagctgtgctgccaaggtggtttttttgtttgtttgtttgtttgtttttgctcgggaactaagaaaactggtggaagggtggaagaaagtttggaggaaaaagacttaggtgcaaagaaagctgtcaagaggcagttaaaatgtcaagacatgagactccaacaaagggaacagcattgaaaggagtggatgtatggatatgacagcgatttaagagttgtttactttttagaacaattttctcagcaaaaaaagagtggaagtcacatttataagtttttctccttttttaaaaaatttcactttagtagcttcccttcccttactactaaaaattaccagttacctgaatttttctataattaatgtttttagcttaatgttctttagtaggtaataatgaagatttctgtgagtgtagatcactttcatacaaatactttgttgggtgtacttattaaaattaaaaagctgaaatcttataaccaaatactgcaggggggttatagacagctctgtaatatccaacacaggtggaggtaactgttacatgaattgctgaaaattgaataagctaccataccttttaaggaagcaaatttttgataccatgatagataggagttagagaaattgcctaatagtagggaagctgggatttagtaagtactgcattttaataatgggtcagcacatcaccagaagtaggtaatggactgtctcaagtatagctaagttggcattggttgtctgtggacacatgcttggcttccattcctttgtcccaaaagcctgatcaaggtgttagaaggacctggatgttatacatcactgagagagaatcataattgactatatatcctaagtctgattttattaagaagtcttctctggagatcaggccctctggtaggtgccatatcactcctttaaacttgtgacttaaaacagcagagtaccttaggagttactatcttttaaaagttcagactccaagagagttttgttaaagccaaataaaatagaagtctgatcactgcttggcagttttggctagtgtaggaatgttaatcttttataagtaaataattgaaacaaattaggccgagtgcagtgacacataggccaagtgcagtgactcacgcctgttatcccaacactttgggatgctaaggtgggaggatggctgcattccagcctgggcaactgcgagaccctgcttctaaaaatcagttaatcaaaatgaggtccaaagattattaatgtgtaattttatgtagcttaatttagggaaaatatccacagaattatgctgtacaatgcttctgattttcctactgataaacagttattagaaaataattggataaaaataattagtaggacagttgaaggtgtttctctaatatgcattaactgttatttatttatttatttttttcttttttcctgcggaccccgttctgctgagagcatcaactattcttaatggtgatcagcttccaagtattctttttttttttttttttggagacagagtctcgctctgtcccaggctggaccaagtattctcttaatggtgatcagcttccaagtattctctctccaccttgtcaaggttatcttatcaattggtcttggttagatttttatttcttttttttaatttctttttttttttttttttttgagacagggtcttgctttcttccccaggctggaatgcagtggcattatcatagctcactgcagcctcaggctcctaggctcaagtagtcctcccacaacaacctccaaagtagctgggactgcaggcacataccaccatgcttggctaattattattttttttagaggcgaggtctcactgtgttgcccaggctggtctcaaactccgggtttcagcctgtgcccggccttctttcatataaaaccaggatccaattaaagcctatgtaaacttaagatgtatgtattaactgaagaaaaaacagagcatgcatcattcaacattcattcagcaaatgattatttagtgctggacactgttttaggtactgaacaaactgtagatagaacaaacaaggtccatctctcatggagcttacattctagtgggacagggaagagacaaaaaataagcaagtaaataaggtcatttcgaacgataagtgcaatgaaggaaaataggataatgttttcccagcaccatttattgagtagggaagcctttccccattctttgttttcatcaggtttgtcgaagatcagatagttgtaggtgtgcggtcttatttctgtattctctattctgttctattggtctgtgtgtctctttttgtaccagtaccatgctgtttggtaactgtagcactgtagcatagtttgaagtcgggtagcatgatgcctccagctttgttctttttgcttaggatttgccttggctattcaggctcttttttggttccctatgaattttaaaataaaatttcctagttctgtgaagaatctcagtggtagtttaatagtaatggcattaagtctatacattgccttgggcagtgtggccattttaacgatattgattcttcctatccatgagcttggaatgtttttccatttgtttgtgtcatctctggtttctttgagcagtggtttgtagttctcctttcacctccctagttagctgtattcataggtattttcttttcgtggcaattgcaaatgatgggagtttattcctgatttggctctctgcttggctgttattagtgtataataatgctagtgatttttgcacatttattttgtatcctgagactttgttgaagttgtttatcagcttaagaatcttttgggctgagactatgggttatctagatataagatcatgttgtctgcaaacagggatagtttgacatcctctcctcaatcccattactgggtatatacccaaaggaatataaatcattctattataaagacacatgcacacacatgttcattgcagcactattcacaatagcaaagacatgaaatcaacctaaatgcccatcaatgatagactggataaagaaaatgtagtacatatacaccatggaatactatgcagccataaaaaagaacgagatcatgtcctttgcagggccatggatggagctggaggccattatccttagcaaatcaatgcaggaacagaaaaccaaatactgcatgttctcacttataggtgggagctaaatgatgtggacacatgaacccatagaggggaacaacacatgttgaggcctatcagagggtgaagggtgggaggagggagaggatcaggaaaaatgactaatgtgtactaggcttaatacctgggtgatgaaataatctgtgcaacaaaaccccatgacacaagtttacctgtgtaacaaatctgcacatgtacccctgaacttaaagttaaaaaaaaaaagaaaaataggataatgtgatagaaagttaaggagtcagctaaggctattttgagatggtcagggaagtattttctgataaaatagcacttgagctatgaccctaatggcaaggaatcatcctattggccagaatgtaattgtgggggagtgatatgagagggagatgaggagtgtagaagatatcaaaaatgtaggcagaggctatgtcatgtttaggccttcatgggccttggtactgtttggattttatctaatacttaagagtccatgaaacatttttttttttctagaagaatctgtgtaagattggtagtattctccaaattctgggggaggaattcagtgctcgaagatattgcaagtcctacagaaatttcactggcacgttaaatctttaacattttaataatctctggagtaatttcattattgagcctattgtgatcatatcctgatacttgtataagtgccacctaaataattaatgtgccttgagtcctttatctgtctaaaatggttataatgaccttcctctaacaaactctgtgatgtgcacaaagaattatggttttttttcctcagtatcaagagtagcattcaaattgctgtgcttctataaatagacaacttaagattgagaagagtattgtattgagatttgcaaatatatgattgtcttattttaccctaattttttccagcagaaatgcagtatccatttctaacctcccaaatatatatatatatgtacgtatgtgtatataaatgtatacgtagatatatatgtatttttggtgggtttaatttttttcatcttttttcatagtttttttaggggcttcatttaacttctggttaagtcttgatttcttttatctaaagcatgtagaattttaagaaaactattccctgaatgtggttttctgtgttataaacttttgtatttgtgcatatttatggagcaatgctttggggaaaataacaatttttattcagccccttgcttaaatccttaatcctttttagctataaaagtacgtagaagttcttatcgtccattacagttttttaatgttaaaaagttgagcaagttttcacatttaaaggtaaatatcctattgcagaataatagaatattgctgatgggtaactttcttatgcaaattacattgtcccatttggcataaaatttctgagcatctatcagtattcagaaatctaagccctttaggctgggcacagtggctcacacctataatcccagcactttgggaggctgaggtgggtagatcacttgaggtcaggagttcaagaccagcctggccaacaaggtgaaactctgtctgtactaaaattacaaaaattagccaggtgtggtggcacgcgcctataatcccagctactcgggaggctgaggcaggagaatcacttgaacccgggaagcagaggttgcagtgagccaggattgtgccactgcactccagcctgggtgacagagtaaaactctgtctcaaaaaaaaaaaaaaaaaaaaaagaagaagaagaaatcaaagccctttaagggcctttgatttattaatgctacattttctcatttgtacccctttaaagcatatttttaaagaaaagatgtcatcatttggtctctatttcttttctttttcaaacaggaaacagagaacactgcatacaaagttggaaatgagtcccctgtacaagaattgaaacaagatgtgtctaaaaaggttggaaagatacaatgtcaatattagtttatagcagacatcatatttatatggtatatttcaaacagcttttatattcttttagtatagcgctctgtacatggctgatgttcagcaaatgtttcatgaatctgtcacatttgtggttgaagacatttcagtctttttagaagtccttttcatattctaattggtaatttatccttgagacaatattttgtaaaatgcttttattttttgttcttgtatttttatcagaataagccctaactcttcttgaggttactaccaggagttatgggtattgaaaagctcagtgcagcaacattctgatgtctttaggaatcagaagttataagaagtccttactctgatagtacctgataccttttaaaaaattgatgctatgaagcttcaaaggttggtttactagaagagactgagcacaagatcagtattttgaaaatgggcagtttacagtatcaggataaaactcaaggagaaagacaggatggtgtgtttttattcatttatacaagttttaagtgttttctgtgccctaggcaatgttctagccagtgggtttccagaggctaacaaaatgacacattctccaccccagagtttctccagtactggcactcgacattttgggctaatagagggtaggggaaggcctgttgtgtgcattgtaagatgttttagcagtatccccagcttctacttactaaatgccaatagcatcctcaactcccaattatgacaaccaaatatatctccagatgtctgggaaggggtatggaacaaaataacccctaatggaaaaccactgttctatccttatggaatttagaaatttaatggactacattttttttttatttgaggcagggtctcactctgtcgcccaagctagagtgcagtggcacaatcatggctcactgtagcctccacctcctggactcaagtgatcctcccacctcaccctcctgagtagctgggactacaggtgtatgccaccatgcctggataatttttgtatattttatagagacaaggttttgccatgtttcccaggctggtcttgaaattctgagctcaggcaatccacccacctcagcctcccgaagtgctgggattataggtgtgcaacactgtgcccagcgagaccacatattttgatattgatcatactttttcctttaaaggaaaaatgttcccttttgggacgaatggtggattgcatagcagtgtacataacaggaattgaaccatttttttaaaaaaataagaaattgcctataattctatactataacacacaggtgtcttgatttttcagcatttccttctggtcctcatccattagcatacatttttctgcctaattgtagtgtaggtagaattttatattctgtcttttactcttaccatttttagattttcctcatacttctatatgagttctgtactcagatgcatcagattccatcaagtaaatggattacaatgttatctagccatttttattgttgaaacttaaaatattcctgttttttccactatagcttttcttattttttaaagaatgtttttcttaggataaataacaaatgtataactatctatagttagtggggaaaaaagatgattttaaggagagtttagaagtttaaacagtagtgagaaaacactgtggagcagaatgaggtttaagattctaaataatcactttttaagttctagccttttcagttgaattaagtatgaatcactaatgataaaggctatggggatataccctggacgagggcatactctgctctcgagtaacttacattttagtagaagaaattggataaacacaaaactaaatgcagtaagtattcaaataaacttagaagctattgtaagaacacaaagggaaggagacttcttgcttgggggtaggaatgaagatgacttcatggaggaggtagcatctgagctggttcttaatgaatgcataagatttggacaggctaggccgggcacggtggctcacgcctataatcccagcactttgggaggccgaggcaggcggatcacctgaggtcgggagttcgagaccagcctgaccaacatggagaaaccccatctctactaaaaatacaaaaattagctgggcgtggtggcgtgtccctgtagtcccagctacttgggaggccaaggcaggagaatcgcttgaacctggaggcagaggttgcagtgagctgaaattgcgccactgcactccagcctggtgacagagctagactccctctcaaaaaaaaaaaaaaaaaaaaggatttggccaggctaagatgggagaggaaaggcattactgaaggcatggaggtggggaatgtgcagaacatttgaggatgagcctagagagcaaagttagggctggattataggaatgccttatgtcatactaaactgtctgctttttatttatttatttatttattttttgagacttgagtctcgctctgttgcccaggctagagtgcagtggtgtgatctcagctcactgcaacctccacctcctgggttgaagcaattcttctgcctcagcctcccaagtagctgggtttacaccaacacaccaccacgccaggctaattttttatatttatttatttatttatttattttgtatttttagtagagatggggtttcaccatgttggccaggctggttttgaactcctgacctcagttgatccgcccacctcagcctcccaaagtgctgggattacaagcataagtcaccgtgtccggtcacagtgagctttttgcagcaaacaatgctttagcataatcatctctatgtgtgtcttggttctcattgttctcttagtctttccgttttcactatttcctaaaatccagaaaaaaatgacagggctaggcaccataagaaggtgtcatgaggcatatcaagaggcaaaaaacatggacctttctctccaggtactaattatctggtgtagagaaaataaatagagctagcctatatacagctctgtatttgtattatagttcatactatactgaacagtaagaataataatagaagtgcagaggagggagagattattatcagataagggattggggaagatgcattttcaacctcattttgacccctcttgtggcacagacatttccattatgtgtagtgattatttcaaacctttatactcacctcatgctcactgtacccactcacatccccctcactttcagccgataaccttgtttcctactccacgtaaatattagaggctaaaaagcctgaatccattcctttgtatcatctttcacttcctttacctacatatttattgttatttcttacctttttttcatgtcatccatcactgaagatttagtattcttgttttctgtccaaagtagtgtggtataatacaaagatcactggatttttaagtaagacctggatttcagttttggctttgtagcttactaattgtgggactggcaaaattcttaaagcctttacctcagagtcctgcttttctaggagggaggtaatccagctacctaacccaaaggcctgtatgacaattaaatgagaatgtgtatactaggtctaatacacagtaggccttctttcctttcttttccagaacattgctctgttatcttcttttccagtagttccttcccttcaggttataaaagtgctgggtcactttatcgaagtctttttgcatttatagctaagctttttgaaaactcagaccgtgctaatgtctctgtatcttcacctcttattcaatctcaaatccattgtaatatgacttctgttatcactgttatcattgaggttctcagtgctcagtaaccacctaattgacaaattggttggactctggttagttttggtgaaagcaaggtaatttctaaggttaacaatttgaagtttgagaaaaactaacatatagaacatgctaagaaatcagggatgaatattactgagcagcagtaatacccagttcaagttagcatgaaattgtagtaaaccagattaggatggttctatgatgcattctgttaactttctgaagccagggaattgagaaagcagaagttgttcatggttggacatggtggcaggataagtgatctgggagatttaatattagtaatgacaagactggggagaaaatatattctaaatgttggcagaagataatagaaagcctgtttatattttaagctacatataagaaagggggccaggcgcagtggctcatgcctgtaatcccagcactttgggaggctgaggcaggtggatcacatgaggtcgggagttaaaggccagcctggccaacatggtgaaacctcgtctctactaaaaatacaaaaattatcccggcgtggagcacctgtaatctcagcttttagggaggctgaggcaggagaattgcttgaacctgggaggcagaggttgcagtgagccaagatcgtgccactgcactccagcctgggtgacagagtgagactccatttcaaaaaagaaaaagaaaggaagggaaaagacaaggtggactgggtatttgaactcttttcatggtcctgccatcagtccacatagtggagtttaggtgtagtctgtttaagaatgttaatctccctgcatctgctggtttttgggtcataagcttgagttcagagctaaacaacttgaattcttctcctggggatttggattatcgtggtttggttaagtaggctcaaaccattaggctggtattacaacaagtttggcataaatatgtaaatgaatcaggatattgagtcttaatgtaagtttaggattgaacttgattttacaggattatttgatcttttgtacctaagtattaacacaaatttgctattatgagggttaagagtatagatgctggaatcaaactccctgggtttatacctgcttcatcacttactagctttgtgaccttggacaaatcatttgattagttccctaatttgtaaaatggtgacagtaggagtagaatctcataaggttgttgtaaagattaaaatatgtaaagtgttaagaacattgcctggcacatactaagtactatgtaaatgattagctgttactgtgttcttataaatagcttcatttttaaaaactacttttaaccctttcatcagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatggcaagtattaattgagaaatcactctgttggttgggcacagtggctcacgcctgtaatcccagcactttgggaggccaaggcgggcggatcgcttgagctcagttcaagaccagcctgggcaacatggcaaaaccccatctgagcaacaacaacaaaaaaaaatacaaaagttagctggccatggtggcacgcgcctgtagtcccagctacttgggaggctgaggcaggagagttgcttgggcctgggaggcagagactgcagtgagccaaggtcgcgccattgcactccagcctgggtgatcagagtgaaatcttgtctcaaaaaaaaaaaaaaagagagaaataactctttgtggtgaaattttggagttgaaactgtttacctttctgcctttatttcactttattaaaaaactcactggcaaccaagttattaaaattatttctttagtaatagacaaaatgtaaaaatgtttacattggtgaaaattactttactgtaattgaacacttcagcagacttcaaactttcaattctgttgccatctgagagagagtggcatggtgaaaaaaacttgggatttggagacctaaagtctgaattcaagtcctgcatcttttttttgtatgagctgtatagtcttgaggaaattaaataacttgtttgaaccatggtttccctgtataggaaatgagagtaatcaagccactttcctcacagggttgttacaagaatcaaacaaaaagggttgttattattgttgttattattatcattgcagttcccaaagagaatattacgtctgattctctcctaaccgcaagcatggcttcagaaagtacggttaaggattctcagccttctcttgatttggcaagtgctaccagtggagataaaatagttaccgcccaggttggtgaattagtgttctgtttcatatagactttatcagctccctgcaactggctggtttgttgatgattattctgtattctccaggccagatttttctttgtcctccaaacctgacccccttacttctcttgatcagctctgctacatgctaactgggtgagcctagcaagctgtttagcatctggatctcagatgccccatcaataaaatggaggaaaagtccttccttgagggtttgaaatgagctaaaatatgccaagtatctagcaggtaataggtattcaaaaaacgacagatgctactatttgtaatattgttggtactaataaacaccaactatagtctatgtttgtcctgtattggtcagaattgaagactttttttttttataatttccttttcctaatcatagaaaaactttatatgctaggaagcgggctacacaaaagacttgataacactaattttaccacagccagattctgggactcagagctacttacatggtagctgtggtgggccaggctaccacactagaatataggacactatagtcttgttatagccttagagcaggggtcagtagtggcctgctttaggaggttccccaagctaagaatgttctttacatttttaaaggttgtttaaaataagaagaagaatatgtgacagagactctatatgaacaaaaatgccttaaatatttactgtatggctctttatagagagaagttttctgacccctacctttgaggtagccacatacagtccagattaatagcagtcttagtagagaaatgccttttggccaggttcaaatagaacatttatttgttttcaagaatactaagacattatttcatgagcagcaatagttttggttcctaatgtttttcagcatgctgggaaaaatgaaggactgaaacgtaatgttccatttagattttcagcagactccattatctgaattatgaaattctttagaattatatgtggtaataattgaaaatttatagaaattgattcagtctaatttctgtttataaaattatatttccaggaaaatggaaaagcacctgatgggcagactgtagcaggtgaagtgatgggccctcagagacctagatccaactctgggagagagcttactgatgaggtagaaatagatttttttgttcttgttcttaaaacataaagtacaaaaaacataatgggaagatgaaaacgttctggagatggatggtaatgatggttgcatgacaatgtgaatgtacttaatgacccagaactatacacttaaaaatggttaaaatggtaaattttatgttatgtgtagtttaccacaatttaattttttttaagtttattgctgttacacacaaaaaaaaatacagaagaaaaaatgaaaattgaagattgtctttgttgatatgctggatgtagcatctctgacttaaacttgccctttcactgtgttgcatagtggaataaatatattgaaagcaaggtttatattttatagaaagtgggctttaaaagaacttgatattgaggccaggtgtggtggctcactcctgtaatcccagcactttgggaggccaaggtgggcaggtcacttgaggtcaggagtttgagaccagcctggccaacatggcaaaaccctgtctctactaaaaatacaaaaattagccaggcatggtggtgtgcatctgtaatcccagttacccagaggctgaggcaggagaatcacttgaacctgggaggcggaggttgcagtgagccgagatcacaccactgcactccaacctgggcgacagagcaagactcggtctcaagaaaaaaaatttaaaataatataataataaaagaacttgatattatgaatatatgttataccaaaataaatttttttattattttaatggtttcttatcattaaaacttagtatgcacctattagccaacttattcagaattaaattttacagcaaaatcttagttgatgtttctttaaaacaatacatttcttaaaatattgcactttggaaaacagtttggcaattcctcaaaatgtgaaacatagtgttaccatgacccagcaattccgttcctttgtatataccaatgagaaatgaaaacatatgttcacacaaaaaaatgtacacaaatattcacagcatcatcattcataacagccagaaagtggaaacaacccaaatgttcatcactgattggatggataaataaaatgtggtatattcataccatgttatattttttagcaattaaaaggaatgaagggataaagtactgatacatgctacaacatggataaaccttgaaaacatcatgttaagttaaagaaaccgacataaaacgccatatattacaggatttgatttatatgaaatgtatggaataggcaaatctatagagacagaaagtagattggtatttgccaggggctaaaaagaaagggaaatgaggtgtgactgctaatgggtagggaatttccttttggggtgcagaaaatattctgacttagtggcaatagttgtacaactctgtgaatatactaaaaaccattgaattatatgctttaaatgagtgcattttgtggcatgtgaattatatctcaataaaaatgttagaaattattgtgtgcagtattgaatatatctaaaaagcctttagcttaaattttaggggattttgtagactcaaaaagataattaaattgcaggtcatcttggtgtgattgttttttttttttaacctcaggaaattttagccagtgtaatgattaagaacctggatactggagaagaaatacctttgagtcttgcagaagagaaactaccaacaggcattaatcctctcactctacacatcatgagaaggacaaaagaatatgtaaggtatggcctaatgttgttatttgtcatttctagtatttcagagttgttaagatttctctgttaatgaactatgacaacccctaatttggtttcattcagtcttttttcttctggaattaaaatagagttagataatgtatgtattctttaactttgctcttcattatgactgtacagttacttggggaaaatagtataaatattaaatcccatagcacttaatttctcttttttaatgatttaaattatacttgagacaatataaaaacagtgaggcagccaggcgtgatagttcatgcctgtaatcccagcactttaggaggctgaggcagcacttgaattcaggagttagagaggagcctgggcaacatagtgagacctcatctccacaaaaataaataaataaattaaaataacagaaaaatgaggctaaaaagctatgtagaatgaacacttagtcttctgaaaccttgctttaaggatcataaattgtttaaatatttgtactgtttttgtaggatcagaaaatggctttaaaatgagatgagtgactttactacgagatgtatgtggatctattgaatcattttggtaaaagcaggagctattttattaaatgtaatgcaggatgtacttaatgagtggggaggaagatacctacaagttactttattatttccctatagcacattttgccaagcaaaaaggtttgtttgtagtaggtttttcataaatttctaaattgcattcatttacatgttgtacattgaaccttgcttaaagattcttttcttcaatttctgaagcctttaagttgtcaggtccatcatttaaattaaaattatatgggccgagcacagtggctcacacccgtaattctagcactttaggaggccaaggtgggtggattgcctgagctcaggagttcgacacgagcctgggcaacatggtgaaaccctgtctctactaaaatacaaaaaattagccagacatggtggtgtgcgcctatagtcccaagtactcaggaggctgaggcaggagaattgcttgaaccagggaggcggaggttgcagtgagccaagattgtgccactgcactgcagcttgggcgacagagcaagactccatctcctaaataaataaataaataattaaaattatgtaaagcttattagcgtagtttttcttattctgattaactggttatatagtaagtataaacagatttttaagaagtatagaagaaatggcttcttttaaaacaacttccccttcttacagtaatgacgcggcacagtcagatgatgaagagaagttacagtctcagccaacagatactgatggtggaaggttaaaacagaaaacgtgagttacagtacatcccttttcttcatttcaagtttttatttaaaaaaatatgagaactaccatactattttaaatcatgctccatgtagtttttatgtctacccaccaccattcctccctgtccctcgctgatgggttatgaagttgtattgattagttttaaagcatctgggctgggcgcaatggctcacgcctataatcccatcactttgggaggccaaggcaggcagatctcctgagatcaggggttcaagaccagcctggccaacatggtgaaaccccatctctactaaaaatacaaaaattagttgggcatgatgacaggtgcctgtaatcccagctacttgggaggctgaggcaggagaatcacttgaacccaggaggtggactccactgcactccagcctgggcgacagagcaagactccccctcaaaaaaaaaatggtaataataataaagcatctgacatacagaaaatgaccagtaagtgttgcaccatacttgtgttatttttctaccagtaggtaggtacgaaaagtgttagtagaagaacatgattgtccttgaagttgtcttttccctttctctttatctctgcaatcctatttgtctttctaaacccaactataatgagattcctcctgactactacagtccatggcaattttctttcttttctcaattttgggaatacctgtagtctataacttactttttccctttacaatatgttatcttaaactgttttcagacaaatacacattaaacaatcaaagcgtatgttgcaaaaggattctgattatgccatcctttgtttcccctacaaacttctagatcaatggtgggcctgtacattttgtttgattatacacaagtcactaaattgataataattaactctaaggtccaaagtgaattatccacttgagtccttttcctagtgtgtatcaaagaaagcattgagaatttttaggaaagatgtacctaaaatgcaggcatatgatagcaccttagatatttggaacttggccatctagtagttgcagttattgggaacctgagaataaggaattactacaattattctgggacagataaacatccagaagagatgtcacatagtccatgcactaaagctcattatttttctaagagaaaagttcctcaggtttattcaaagccattatgcttatttcttacatcattttttttaaaactctgttcagtgtctgagcttactgcaaaatagaagcagcaaactgtgacaacatgtaagttgacacataagaatgtcaggtaatcagaaaaatgataaaataactcataatataggtgggtgcagtggctcacacctgtaatcctagcattttgggagaccaaagtaggaggatcacttgagcccaggagtttgagagcagcctgagcaacacaggtagactcactctttaccaaaaaattttaaaaattagccaggcatggtggcacacacatgtggtctcagctactcaggaggctgacatgggagaattgcttgagcctgagggatcgaggctgcagtgagccgtgatcacaccactgcacttcggcctgggtgacagagcaagaccttgtcccccacaccccccaccaaaaaaaaaaaactcatagcacaatcattgtaccacagtgcttttcaaccttttcttatgccattgacacacagagaacataatagtatttgcactgaatgttggggtaagctggccatcagctgatggccagagaagattggcccaggcttccctgggccctgccctgttgccttgaaggctgagtggggaaccaatagtatggcccacctgcaatgcattagaaaggctctgaatgtattaaagaaccaaaatgatggtaacgatcttatccatcaaggaatgaaatttagggaacattaagtgccatttaagaaggcataaaagtagatactttagaactattaccatctgaaataattaaaatgtctgttttcttggcttttaaagtggtagtaaacttataattatccagaaaatacagcttcagagttataggtagcagagaccttataatggctttaaaaatggtttatcatctgtgttttctggttatcaaaagaaatacagaaatatgtaaaatagaaaatgaaagtttctcataatctcagccccagaaatcagttttgtttttttttttattatactttaagttttagggtacatgtgcacattgtgcaggttagttacacatgtatacatgtgccatgctggtgcgctgcacccactaactcgtcatctagcattaggtatatctcccaatgctatccctccccactccccccaccccaccacagtccccagagtgtgatattccccttcctgagtccatgtgatctcattgttcaattcccacctatgagtgagaatatgtggtgtttggttttttgttcttgcgatagtttactgagaatgatgatttccaatttcatccatgtccctacaaaggacatgaactcatcattttgtatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagtccattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataagatgtaaggaagggatccagtttcagctttctacatatggctagccaatccagaaatcagttttaatagcatggtgtattcgccatagaatttttttttctcgtaaaagcggggctactctatgtctatagtttgtcaacttgctgttttttgttttttttgtttttttggtttttttttagaaaatcaaatatatcatagacatctctttatatcagcactaataatatatatattgtagtctttctgagagccagatatgagagttaagtgcttgggatataacagttaagacattaagaggccaggcgtggtggctcatgcctgtaatccagcactttgggaggccgaggcaggtggattacctgaggtcaggagttcacgaccagcccggccaacatggtgaaagcccatctctactaaaaatacaaaaaattagctgggcatggtggtgggcgcctgtactcctagctactcgggaggctgaagcaggagaattgcttgaacccaggaggcagagattgcagtgagctgagatcatgcctttgcactccagcctgggcatcaagagtgaaactctgtctcaaaaaaaaaaaaaaaaaaaaaaaacattcaggatgggtgcaatggctcatgcttgtaatccgagcactttgggaggccaaggcaggtggatcacttgagtccaggagttcaagaccagcctgggcaacatggcaggaccccgtctctacaaaaaatacaaaaattagccaggcatggtggtgtgtgcctgtaatcccagcaactcagaaggcagaggcaggtgggtctattgatcctgggatgtcaaggctgcagtgagccaaaatcatgccactgcactccagtctgggcaacagagcaagactctgtctcaattaaaaacaatttataaaaaagacattcgtggtctctgccttcatagaacttctgttaaatgggagaaataggcattaaacatgtaattgcacagataagtctagctacatttgtagtgattgctataaaagaaaagttccaggtgctgtggagatattacagtagttccctcttatccatggggtatacgttccaagatccccagtggatacctgaaatcacagatagtaccagactctgtatctactgtgttttttctatctgataaccaagaagactactaagtaataagtgggtatcatctatagcgtggaaacactggacagagggatgattcacatcccaggtaggatggagcagggtggtgtgagatttcatcatgctactcagaatggcacacgatttaaaacttacaaattgttttatttctgggattttccatttaatatttttggaccatggttgactggggtaactgaaaccatgtaaagtcaaacttgggataaacggggactatgtaacaaaaactctgtctaaagttaaaaaggccattttgagagagctgtttgatctgagacctaaaaagtgagtgggaattagccaagggagaggtgttccaggcagaaataaccacacatgcaaagcccctgaggttactataagagcttggcacatttaaaaagctgaggtttgcctcattaattttattgtatttcataccagcacttatttatctgttcctctattgacaaaaaaaaatttagtttatttccactttttgactattctaaacagtgttacattgaacttctctgtatatataacttaacaacttttaaaaatactgtccctcatgagctcccatgaatcagtaaaaatttactcctgatttgtatttcttttggttttaaatatcatcatgtactgtgcattgctttttgtaatcttaatatatgaaatctgagacttagctaattgaaaatgcaataagtaagtcctatttatggaagcttgagatgcatacttagtttacctcgtatttgggaatacctactaggaaaactcagcctaattttattacatgcacctacccaaactgaaagagaagggacaagggaccatcttaagctaccaaagcattctattttgtgaggaaatatctctttactctttattggtaaaatgtgtttttaagaacagctctctaaagcagccttctcaaagcagttctcacccccagactctctaaattggattatctggggatggagctgaagtacctacactttaaacactcccctctccacactacctctgccaatcaatttttattcaccattgaaaaccaaagctctagaatatatgaatattgtaaattgggggaaagggtgtatgtttcctttgccatattgacttgaatatgtttattccatagaataagggatttggaactcaaacacctattatttatgtttaaaaaagttatttcaaagtagtgtactttatcagtcacagctgatacatttgtctgcaaattattggacttttacagttaactgagttgatacttttttcatttttgttaaggactcaactaaagaagtttcttggaaaatcagtaaagagagcaaagcaccttgctgaggaatatggtgaacgtgctataaataaagttaaaagtgttagagatgaaggtgagttaaaacagaacatttcaactaaacattcaattaatttgtaatcgtctaaatttagcctgtagtttgtaagaagcattctatttaaaatagtaaacctttatagctgacatcttagtatttcaataaataaggtactctatgacttaattttatgagtgtgaagaaaaatggatttatacatattttgtgacttttgacagtctgaaatggttgagtgttaaataatcagttatgaattagtttcgtttgtttgtttgtttgtttatttgagatggagtcttactctgttgcccaggctggagtgcagtggcgcgatctcggctcactgcaagctccacctcccaggttcacaccattctcctgcctcagcctcccgagtagctgggactacaggcgcctgccaccacacctggctaattttttgtgtttttagtagagacggggtttcactgtgttagccaggatggtctcgatctcctgacctcgtgatctgcctgcctcggactcccaaagtgctgggattacaggcgtgagccactgcacccggccataaattagttttttaaggctatttggttttgggtttttcttttttctttttttttgagaaagtcttgctctgtcgcccagactggggtggaatggcatgatcttggctcactgcaacctccgtctcctgggttcaagccattctcctgcctcagcttaccaagtagctgggattataggcacacaccaccacacctggctaatttttgtatttttagcagagacagggttttgccatgttggccaggctggtattgaactcctgacctcaggtgatccacccacttctacctcccaaaatgctggaattacaggcatgagccaccacgtctggccaaggctatttttttcttttttggagatggagtctcgctctgtcacccaggctggagtacagtggcacgatctcggctcacttcaacctctgcctcctgggttcaaacaattctcctgcctcagcctcccaagtagctgggattacaggcacctgccaccacacctggctaatttttgtatttttagtagggacagggtttcaccatgttgcccaagctggtctcgcactgatgacctcaggtgatctgcccacctcagcctctcaaagctctgggattacaagcgtgagccaccgcgcctggccagctatttggtttttacaaatacagtcagtcctccatatccatgggttccacatggagggattcaaacaaccacagatagaaaaatatttttaaaaatatataaaaaataacaatgcaacaataaaacataatagaaaaaataatataacaactatttatataacatttacactgcagtagatattataagtaatctagagattatttaaagtatacagggcgaggcatggtggctcatgcctataattccagtactttgagaggccaagacaggagaaccgcttgaggccaggagttcgagactagcctggtcaaacatagtgagaccctgtctctactaaaaaataaaaattagctttgtgtagtgacgtgtgcctatagtcccagctactcagaaggccaaggagcaggattgcttgagcccaagagttcagggctgcaatgagctatgattgcaccattgcactccaacctgagaccctgtctttaaaaaagaaagcaagtacgtgaaaggatgtgcataggttatatgcaaataccatgccattttatgttaagggatttgagcattcgcagattttggtacccatagcaggtcctgccatggatactggggaataactgtattttcaaaattaggtagggctgggtatgatggctcatatctgtaatcccaacactttggaaggctaaggcaggaggatcacttaagcccaggagttggagaccagcttgggcaacatagtgagacccctgtttgtataaaaataaataaataaatttttttaattaggtaaattttctaaatttgcacatatcttaacctcctatgcttttgtcattattgtactcatttgttttatttaatgaaacttacatagtacttattcagtgcctgggactgtactaagcacttttacctgtattaattcatttaatcccatagaaaccctatgaggtaagtaccatcattatccccatttgatagatgagaaaactaagaggcatcgaaagttgagtaacttgcctgtggtcacacagataataaatgacagagctggatttgaacctggcagtctggcattagactccatgtttttaaccagtatgttatataataaataaattttgctcttccatttaatgaattttcttggtatgcaggaaatatgaaattatgataatagcaatatctacattagctagtagtgatttctgttgcttttctgttcagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatggtaagcaactttttcattttttaggattgatactgtttttgttaagagaaatactttggcttctacaaaactatctctttctatgtatgtaactttgctagcctgactcaagaacggggaatttatgttaacatgatttaatgaataggtaatgcaaagtctatctctgaattattccagaagtgacttatcggccaggtgcggtggctcacgcctgtaatcccagcactttgggaggccaagacaggcggatcacttgaggtcaggagttcgagaccagcctgaccaacatggcgaaaccctgtctctacgaaaaatataaaaattagccaagcatggtggcgggtgcctgtaatcccagctacttgggaggctgaggcaggagaattgcttgaacccaggaggcagaggttgtggtgagtcgagtttgtgccactgcactccagcctgggctacagagtaaaaaactccgtctcaaaaaaaaaaaaaaaagaaagaaaggagttattgaataagtaaactctcaggctgtatcactaagaaagctatgcaaaggcaccaaactttaaagcagttagattagagggtgtaactttgaaaaatgtttaaaatgctcccaaccatattttaaataatttacaaaatatatcagaagctcaatatatgttgtaaagtgagatattcagctaaaacaaggagagaggtaaaagttcaagttctcctttagagttcaaatgtaccaatgtagatgcaattgcacaaactgtattgtggttaacccctgaaaatgctaggaacacaaagaaggcagtgataaaatttagatctgaataaataatactgtgcccttgatcagggaatctgtttacattttaagtctaaaagttggcttaactagaatgaagcaaccataaatatattggatggcaaccaaattcaaatttaaattttgatgtttacagataaatgtttgagttgattttagtattttccttaaggaaattgatgaatttcctagtactgtattgactcgttatttcctgttttaaataaaatctcatcgtagtaggctccaaatgactcatttttaatacacttgaattttgtagaagtgaatggttatttcaataaatgggctgtggcataatctttttgatacatctgaatgtgtatataatagtatttcttgtaataagatttggtctttccaacttaagaggttcatgttctttctccctgctcctccacccccaccacacacacatactttcctattgttctcagtatctagagattctggtcatatactttgaaaccttgtttctagagagaaaagtaggatgagaccacaccactccaatacaactacctttttttttttttctttttgtggcagagtctcgctctgtcacccaggctggagtgcaggggcgggatctcagctcactgaagcctctgcctcctgggctcaagcagtcctccctcctcagcctcctgagtagctgggaccacaggtgcgcaccaccatgcctggctaattttttgtattttttgtagagatggggtttcgccatgttgcccaggctagtctcaaactcctgagctcaagtgatccacccgcctggacctcccaaagtgctgggattacaggcgcgtgccaccacgcccggcccattccaaaactgtaatacttctaagtgctggatgctatacgggtcactgccaaggtgggctttagtcttcctcagtcctgctcagttgttagtgctatgctgagggctctgccacccatctttacgttcagctaggggactaagatccccagctaggatttgtgcttttccaatgaagatttctgaccactttagaactcccatttctgttaatatgtggacagggtttgagttcttgaagttgttagtttagattatggaacactacaactatcttaccctacctttcttgtgaaagtctacttttgtggtattatagcaccattgaacttttggacttaagtagtgttagcaatttgagcattatcttagtatatgtaatttggcgtaattttaaactttggctttaaagtaatgtctctattttattttatttattattatttttagatagagtttcgcttttgttgcccaggctggagtgcaatggcgcggtcttgactcactgcacccttcacctcccaggttcaagtgatcctcctgcctcagcctcctaagtggctgggattacaggcgcccgccaccatgcccagctaatttttgtatttttagcagagatggggttttaccatgttggccaggctggtctcgaactcctgaccttaggtgatccacctgcctcagcctcccaaagtgctgagattacagacgtgagccaccatgccaggccaaaagtaaagtctctaaaggtgtaaagtattaactttgaaacttcttttgttttcatagggagctgtttggaccatgaaattttctcactgtggccgattacttgcctcagctggacaagacaatgtagtgagaatatgggctttaaaaaatgcttttgactatttcaacaatatgcgaatgaaatacaatactgaaggtatttttcatctatttaaaaatctacagaaacctgaagtttttacattttaggtatactgatgccctacttttctggcagtcatttgcagcaaccactacttatgataatagccaaaaacttgaaagtaagacagacgtcagtggcaaaaagtctctaaacccaatgaaaagagctgccacaaagcttttgatttattcctttccaggtgtagtgtgtagttaatttcatcaactattgagaacatgatatttggtttcctctggcaaccttcagttctatcctaggttaaaatagaattgctaattaaactggaaaaagaatgaaaatcatatatatccagtaagtaaaaatgattaaggaaaaagtcatggaaaatgaatgtgaattgtcaatatatcaagggatatatgaaaaaatgttgaaaagagaagcctcagaacattatgtacacactgattacaactatgtacagatatttatgtatcatggtgttatcaggaaagtatgtagaactgatgtaaatttgggctttaagttcatgggattcttttctaataactatttaactgtgtaataagttttttccacaccctccccgccatcaagtaaggctgcaaacgagaagtaaagcataggagaaaggagaagaaaggtggccatgggtgagagtatatagtcaaagcaccaatttgaggaacataaaagtctagggagattcactaaactggcaagctagacctcatatacttgagtaaatcctgtgagtattgcttgcattatgtttcagtacttagttgaagatgataataatttgacaagaagttaaactgtgtttactatatggtgagtttttctagtcctagctgtgtgtcatttcttttactgccctgccaagagcaaaaagactattttcagtggcccttgagactaaccccagccctgaacctttctgctcctttattgttcctcttgctacttgtcatgattaataagaatgtgttctattcgaatactgaggatttaacggtattttgtttactaaagtagggaaatggttaagccattttatgaagtttttatgtaaaaatgattgaaacaaatattttggctcctatagggttatgcctcaattgttagtatttttctagaatactgtattctctaactattagacattgctgtgtcattacttctggatgttatattttggtgggtctgtgtgtgtacatacatgccttttttacaattattatgttgtttttaggacgtgtgtccccatcaccctctcaggaaagtctaagttcatcaaaatcggatacagatacaggggtatgcttattgttttatggttactctgttttcaggtatgatttaatttgtttaccataaagtatttttgtgtatcagaaattacagttgcatgaagacacttaatataaaattaagatgtatcattagaaccaagagtttcttcaattagaagaaattagcaaatgaaaatttttgatatttaaaggttgccagacagtgaatactattgctcagggtactataccactaatgtaaacttaaataatacaaaagcccctcccctcaaatccatgttagacatttttaaaataatgataatagatacccaaataagaggtaattaaggaaagaaaaaatatatttaagtattttaattttctaatcttcttggtttaataaacactttatcacagtttcagataaggtatcttaatgattttcatttggttttagagctggaaggttaaatataaccaattttaaacctataaagcagaatacacaatattgtactaagttgtcacctgtgttttttgtgtgttgcattaggtaagggtgatataaacaagagaacctaaaatgtctacctgctcaacagtattttcctgagatttcattggctccagtatttgacactacgttttctccttctcctggctttccatggttctgtttccctttgttctcttatactcccactgtttcttcttccatctccttacatttactgtttctcagggtctgttcttggccattttcaatagacatatttatgctcttcttctagtcctgaactggctttagatctgtaattctttgtttactttcagtaactttatgatttttaaacaagaacattattgtgcttgctgccttttcacataatatataggatctctttatctacatgtaatccaaccacatcaactaataggtccaaaactaaactccttcaacaaatgttttctgagtgcctgctatatgtggcagacactgctacatgctataaaatcaaatgagacatattctctgtcctcagggatcttgtgaactagtgaaatgggtaaactcacaattacagtattagatggtgatattctacagaaggtactacacaaaaataggttagccttataaatcacagtgttaggaatagtttcctggaaacttgttatttgagctaggatttagctatatgagagaagaaaggaaggagcgtgtcagacccagggactagcaagtgcaaaagcatggaggctagtatgttaaaggtactacaaggaattacacatggctgggaaaggtgcatttgtgagattggtgggagaggtaggcaggagtggaattttaaatgactttttgtgatgaaccaagatggaactttatcctgcaaactactgggagcagggtggggctttgaaggatttcactcagaggcataattaccatgttcagatttttgttttagaaagagtattctggtagtattgtgaaggatagactaggtgggggcttcaggtttgagacagggagaccatgtaagaggctattaacccagagaaatggttacttccgattttgatgattatgataccagtagagctagaaactgtaaagataagctgaattgagagatgtaaaataagtctaatttgtaggacttggtgactgactagctggggtagtaaaagtgagtagcctgggatgaatcacaggtgtctagcttgcgtagttagctacatggtaatggtcactcatagaaatattttttatattttaatttttccataagttattggggtacaggtggtatttggttacataagttctttagtgattttggtgcacccatcacccaaggagtatacactgcacctatttgtagtcttttattcctcaccctcctcccactcttcctcccaagtccccaaagtccattgtatcattcttacatctttgcgtcctcatagtttagctcccacatatcagtgagaacatacaatgtttggttttccattcctgagttacttctcttagaataatagtctccaatctcatccaggttgctgcaaatgctgttaattcattcctttttatggctgagtagtattccatcgtgtatacataccagtttctttatccactcgttgattgatgggcatttgggttggttccacgtttttgcaattccaaattgtgctgctataaacgtgcgtgtgcaagtatctttttctaataatgacttcttttcctctgggtagatacccaatagtgggattgatggatcaaatgttagttctacttttatttctttaaggaatctccacgctgttttccacagtggttgtattagtttacattcccactagcagtgtagaagtgttccctgatcaccacatccacgccaacatctattttttgattttttattatggccattcttgcaggagtaagatggtatcacatcgaggttttgatttacatttccctgattattgtgatgttgagcattttttcatacgtgtgttggccatttgtatatttttttgagaattgtctatttatgtccttagcccactttttgatggactgtttttttcttactgatttgtttgagtttgttgttcattctggatattagttagtccttagttggatgtatagattgtgaagattttctcccactctgtgggttgtctgtttactctgctgactgttccttttgctgtgcaaaagctcgttagtgtaattaagtcccaactatttatttttattgcatttgcttttgggttcctggtcatgaaatccttgcctaagccaatgtctagaagggtttttccaatgttatcttctagaatttttatgctttcaggtcttagattcgagtccttaatccctcttgagttgatttttgtataaagtgagagatgaggatccagtttcattatcctacacgtggctagccagttatctcagcaccatttgttgaaaagggtgtcctttccccactttttatgtttttgtttgctttgtcaaagatcagttggctgtaaatatttgggtttatttctgggttctctattgttttccattggtctgtgtgcctatgtttataccagtaccatactgtcttggtgactatggccttatagtttgaaatcagtaagtgtgacgcctccgtatttgttcttttgcttagtcttgctttggctgtgtgggctcttttggttccatatgaattttagaattgttttttctaattctgtgaagaatgatggtggtattttgatggggattgcgttgaacttgcgattgctttttttttttttttttttatgttccatggttttgtgtttttttttttccattactggatatatacccaaaggactataaatcatgctgctataaagacacatgcacacgtatgtttattgtggcactattcacaatagcaaagtcttggaaccaacccaaatgtccaacaataatagactggattaagaaaatgtggcagattgctttttgaagtatggccattttcacaatattgattctacccatccatgagcatgggatgtgtttccatttgtttgtgtcgtccatgatttctttcagcagcgttttgtagttttccttgtagatgtctttcgcctctttggttaggtatattcctaagtattttatttttttgcagcttttgtaaaagtgattgagttatcgatttgattcttcgcttggttgctgttggtgtatacaagagctactgatttgtttacattaatcttgtatctggaaactgtgctgaattcttttatcagttctgagctttctggaggagtctttagggtttccgaggtaaatgatcatatcgtcagcaaacagtgacagtttgactttctctttaccccatttgaatgccctttatttctttctcttgtctgattgctctggctaggacttccagtactgtgttgaagaggagtggtaagagtgggcatccttgtcttgttccagttctcagagggaatgctttcaatttttccccattcagtattatgttggctgtgggtttgtcatagatggcttttattacactgagatatgtcacctgtatgctgattttgctgagagttttaatcataaaggatgctggattttgtcaaatgctttttctgcatctattgagatgatcatgtgatttttgtttttaattctgtttatgtggtgtatcacatttattgacttgcatatgttaaaccatccctgcatccctgctatgaaacccacttgaactgggtggattatcttttcgatatgttgttggatttggttagctagtatgttgttaaggattttagcatctatgttcatcagggatattggtctgtagttttcttttttggttgtgtcctttcctgattttggtattagtgggtgatgctggcttcatagaatgaattagggaggattccctctttttctatcttgtggaatagtgtcaaaagaattgttaccaattcttctttgaatgtctggtagaattctgctgtgaatccatctggtcctggactttttttgagatggagtctcactctgttgcccaggctggagtgcagtggcgcaatctcagctcactgcagcctccgcctcctgggttccaacgattctcctgcctcagccttcctggtagctgggattacaggcacacaccaccatgcccggctagtttttgtatttttagtagagacgaggtttcaacatgttggccaggctagtcttgaactcctggcctcaggtgatccgcctgcctcggcctcccaaagtgctgggattacaggcatgagccatcgtgcccagccagtcctggactgttttttttgttgataatttttaaattaccatttcaatctcgctgcttgttattggtctgttcagggtatctatttcttcctaatttaagctaggagggttgtatttttccaggaatttttccatctcttctaggttttctagtttatgtgcataaaggtgttcatagtagccttgaatgatcttttgtatttcagtgatgtcagttgtaatatctcctgtttctcttcttaatgaggttatttggattttctcttttattttcttggttaatcttgctaacagtctatcaattttatttatcttttcaaagaaccagctttgtgtttcatttatcttttgtattttttgtttgtttcaatttagtttaattctgctctgatcttggtaatttcctttcttctgctggctttgggtttggtttgttcttgtttctctagttccttgaagtgtgaccttagcatgtcagtttgtgctctttgagtctttttgatgtaggcatttatagggctatgaactttcctgttagcaccacctttgctgtatcccaaaggttatgatagattgtttcattattgtcattcagttcaaataattttttaatttccatcttgatttcatttttgaccgagtgctcattcaggagcaggttattttatttccatgtatttgcacggtttcgaaggttccttttggagttcatttccagttttattccactgtagtctgagagagtgcttgatataatttcaattttcttaaatttattgaggctcgttttatggcctatcatatggtctatcttggagaaggttccatgcgctattgaatagaatgtgtattctgcagttgttggatggaatgttctgtatatatatctgttaagtccatttgttccaaggtatagtttaaattcgttgtttctttgttgactttctgccttgatgacctgtctagtgctgtcagtggagtattgaagtccccaactattatcgtgttgccgtctatctcatttcttaggtctattagtaattgttttataaatttgggagctccagtcttaggtgcataaatgtttaggattgtgatattttcctgttggacaaggccttttactgttatatcatgtccctctttgtctcttttaaatgctgttgctttaaagtttgttttgtctgatataagaatagctacccctgttcgcttttggtgtccatttgcatgaaacgccttttaccacccctttaagtttatttgagtccttatgtctcctgaagacagcagatagttggttggtgggttcttatccattctgcatctctgtatcttttaactggagcatttaggccacttacattcaatgttagtattgagatgtgagatacctcatagtgttatttgttgcctgtgtaccttggttttttttgtttttgctttttaacttacatttttgttttataggttctgtatgatttatgctttaaagaagttctgttttaatgtgtttccaggatttgtttcaagatttagagctcgttttagcagttcttatagtggtggcttagtagtggcaaattctctcagcatttgtttgtctgaaaacgactgtatctttccttcatatatgatacttagttttactggatacaaaattcttagtgataattgttttgtttgaggaggctgaagatagggccccaatcccttctagcttgtagggtttctgctgagaaatccgctgctaatctgttaggttttcctttatacgttacctggtgcttttgtctcacagctcttaagattctttcctttgtcttaactttagataacgtgatgacagtgtgcctacgcgatgatcattttgtgatgaatttcccacttgttctttgtgcttcttgtatttgaatgtctagatctcgagcaaggccggggaagttttccttgattattcccccaaatatgtttttcaaactttcagacatctcttcttcctcaggaacatcagttattcttaggtttggtgtttaacataatcccagacctcgtagaggcttcattcatattctcttattcttttttctttgtctttgttgtattgggttaatttgaagaccttgtctttgagctctgaatttctttcttctacttgttcaattctattgctgagactttccagagcatttttcatttctataagtgtgtacagtgtttcctgaagtttttattgttttttttctttatgctatccatttccttgaatatttctcccttcacttcttgtatcgttttttggatttcactgcattgggctttgcctttctctggcgcctcccagattaacttaataactaacctcctgaattctttttcaggtaaatcagggatttcttattggtttggatgcattgctgatgaactagtgtgatttttcgggggttgttaaagagccttgttttgtcaaattaccagagttggttttctggttccttctcatttgggtaggctctgtcagagtctagggctgaaggctgttgttcagattcgtttgtcccactgggtgttcccttgatgtagtactcttccctttttcctatggatgtggcttcctgtgagccgagctgcagggattgttatctctcttctgggtctagccacccagcaagtctacccagctctgagctggtactggaggttgtctgcagagagtcctgtgatgtgaaccgtctatgggtctctcagccgtggataccagcacctgtaccagtggaagtggcaggggggtgaaatggactctgtgagggttcttagctttggtggtttaattttctatttttgtgctggttggccttctgctgggaggtggcgctttccaaagagcatcaagctatggtagtatggattggaaatggtggtgggtggggccctagaactctcaagagtatatgccctttgtcttcagctaccagggtggataaggaaggcccatcaggtgggggcagggctaggtgtgtctgagctcagaatctccttggttgggtcttgctgaggctgctgtgggggatggatgtgatgttcccaggtcaatgaagttgcgtacctaggaagattatggctgcctctgctgagtcatgcaggttgtcagggaagcgggggaaagctggcagtcacaggcctcacccagctcccacacaaacggaagggccagtctcactcccaccatgccccctcaacagccccaagtctgtttccaggcagtaggggatctgggcctgagaacttgccccaggctactcacctcccagctgtgaaagaaaaaggcttggttctttccccacctatggagtctgcacaccggattcgtgccctcccccttctggccaggaggcttctcgccagttcaaattgttacaaagttcagctggagacttccttctccctatagtgtttcccctcctattcctctggctgccctcccgaaggatccctgtggtgccaggcaggaatggcctgcttgaagacccagcgagctcccaaggctttcctgctgcttcctctacttctatatttcgctgggctctctaaattgactcagctccaggtaaggtcagaaacttatcctgcaaacagacgttcagtttccccagtgggggtgtgtgttccggagaggaggatctccctttcccacttctgcagtttgggcactcacagtattcggggtgtctcctgggtcctgcaggagcattctgcttccttcagagggtctgtgggttctcttgggattcctagttctttcttgcagtcgatctgcagctaaaattcatggtgtgagcctccgcatgctgctctgtccatctgagtaggagctgcaatctagtcctgcctcctgtctgccatgatggcatcccattatgtttaaaatgtttcttatagatagcatatagttagaccatgtttttttacccactctgccagtttctgttttttaattggtacatttataccatttaaacttactgtaattattgctactttaaactcaaatctgtcatctttatgatcattcattgaaatattttcatcattcacccacaaacctgcttctcctcacttctgaaccttatttagtggcatcaacatctacacgttacctttttaactcaatcaaaaatactccattactttttcttccttacccacatttcaaattagtaacaaattcctagccactctacccccacccacaaatacctgtggaacttaccccctcatccctaattgtcacacacatcgtctaggtcttcaacactcatttaaatgcttgccatagtctcctaattgttttttctgcctctggtctctacccaattcattttctacactgccaccagccagccaggtttttcaaaacagattgactgtgccattgtgtggtttaaaatttttttttcttttttttgagacagagtctcgctctgtcgccgaggctggagtgcagtggcatgatctcggctcatttgcaacctgcgcctcccgggttcaaggggttctcctgcctcagcctcccaaataactggtattacaggcactcaccaccatgcccagctaatttttgtgtttttagtagagatagggtttcaccatgttggccaggctggtcttaaactcctgacctcaagtgatcctcccacctcggccccccaaagtgctgggattacaggcgtgagccaccatgcccagccttgcggtttaaaatcttttgacggccctttatctcccccacaataagattcttccctgtattgcctaatcttaacttttgactcagttccaattccctagtgcctgtgcatcctaccagccgtgcctgatacaggtctgtacactataaacactttcactttcatgtctctgtccctgctgtttgctttgccttcacagggcaaagccctacttatccttcaagattcagctcaaatatcttattattttccctgaatccagcagataaaattgttcttcatttgtattctaatagtacatcataggtacttttatactgatattaccatgtctttcttgttagtctccctggctaggctctgggctgattgaaggcaaagaactgtacttcacagattttagtatccttggaatctaattccattcctgactgtagcaggcccataatcatgttgaattcctgcctgtggaccttattcctattgttccccttatttggatgccttgatcatctttctattcaaagcatgcccattcttcatggcccgcttcctccataaagcctcactgactaatgtagcagagataattttaactgctttgctttagggaaaagggcttgcttttattagtttaatttaccatacagtttccaggcattgattactattaaaaatagagactatctgtagtatcttttattgcgcttatttcagcaatcctacttatagatcctcagctacatccatctaaccccaaacagacctaagtaactcacaattttattgaatacaaagcctttttacatgagaaataacatttatatccattgttttcaggaagagatcatttggggtttgtttcccttctgtcattttatttggggacagttaaaagaggcttctatttcacatgccattagagtttgacaccagaaattatcttctaacctagtgctagccacagtgaggcacagtaaacacaatggagtttatgttcctgatgtgtgtattctttttttcttatgatagtgatatctttttcatctcttttgaagtactttttcagtcttttgtcttagcatctgtgtggaatataatatataaaagtattgtacagtcgaacatacagagtgatgtacccaagatcactcacctgtgcattggtaatgccaagcctagaattctggctactttctgtttctgttaattttcaaaattagctcaataaatgtaagaaagacaggaagaggtgcatgtctaatatgctccattatcttagacacttataaagtagggatttttttaatagttgggttttgcagagactgttagacctcatggcttctaagaattgataattgcatcagattgcaaatatgaatatactgtatccattttaataagtataaaatttctttttgatactagaagctgtaagtatgctatgtacctagaaagtaatgtttttcttgcaaatttatgtttaatgtgcatgactagggaacattagcataggtgttgtagcatttaactgctgcttaaaatttttgagaataggccaggtgcagtggctcatgcctataatcccagcactttgggaggcccaggcaggaggattgcttgagtccaggagtttgagaccagtctgggtaacataacaagactatgtctctatttaaaaaaaaaaaatatatagccaagcatggtggcatgtacctgtagtccagctacttgagaggctgaggcatgaggatcacctgagctcaggagtttgaggttacagtgagctgtgatcaccactgcactccagcctgggcaacagagcaagaccctgtctcgaataaatttttttgagccaggcgcggtggctcatgcctgtaatcctagcactttgaagaggccgaggcaggcggatcacctgaggtcaagtgttcaagaccagcttggccaacatggtgaaacccggtctctactaaaaatacgaaaattagctgggcatggtggcatgtgcctataatcccagctacttgggaggctggggcaggagaattgcttcaaccgggaggcggaggttgcagtgagccaagatcgcaccattgcactccagcctgggtgacaagagcaaaactccgtctcaaaaaaaaaaaaagaaaaatttctgagagtatatcattagaatctagaacttgggtaaaggaagttaactataagggagtgagagaatttttgtgaaatgtaggtatgcagtatttgatacagatttgtcttggtactattaatagcctcactttacaaatgaaggtttagagctgttaagtaactcaacaatttcacacagtcatagcatcagtattagaaccctgctctgtctctagagcttatgtttttaaccattatgctccaatagttgacatcttgaggtctgggactatgtcttcattcactctagagatatttattaagtgcctactatttttattaatcactgttctaggagctagagatatagtaagtgaacaaaagagacaaaaatatctgtgaacaagagacaaaaatagaatggagcatacattctagtggaagaagacagaaaataagtaaattttataatataaagttgttttttttttgagatagagtttcactattgttgcctaggctggagtgcagtggcacaatcttggctcactgcaacctctgcctcctgggttcaagcaattctcctgcctcagcctcccaagtagctggaattacaggcacgtaccaccactcccagctaatttttttgtatttagtagagacggagtttcaccatgttgatcaggctggtctcgaactcctgacctcaggtgatccacccgccttggcctcccaaagtgttgggattacaagcgtgagccactgtgccaggctataagttaattttttaaaccactttattgaggtatgattggtattcaaaaagctgtatgtatttattatatagaacttaatgagtttggagataagtatacaagcatgaaaccatcaccaccgtctgtgccataacccaagcatcacctataaaagtttattctcatcctcttatttattaagtatacgatacagtattgtaaactgtatgcactgtgctatataatagatctctcaaacttaatcattttgaaagtgaaactttgtaccctttgactaataccacctgtttcgccagccccaaggccctcgcaatcactgttctactctgcttctatgagtttgttgtttctagattcatcatataagtggcattatgtagtatttgtccaaaaagtatctggcttaatttcacttagcataatgtcttccagtttcattcatgttatcacaaatgccaggattttctttttatgactgaatagtattctgttgtgtgtatatgccacattttctttatccattcatctgtcaatggacatttaggttgtttccatgtctaggctattgtgaataatgctgcagtgaacatgggagttcagatacctctctgacatactgattttatttactttaaatatatacccagaagtggaattgcaggatcatatggtagttctattttaagttttttcaggaactttcatactggttttcatagtaggtgcaccaatttacattcccatcgactgtacagggttccattttatccacatcttcactaatacttgttatcttatatatatatatatatgtgtgtgtgtgtatgtgtatatatatatatgtgtgtgtgtgtatatatatatatatatatatatatgtatatatatataatgttcatcctaacaggtgtgaggtgatatatcattgtggttttgatttggaaatcaaatcacctgattaattggtgatgttgagcaccttttcatgtactcattggccatttgtatgtcctctttggagaaatgtctatttaggtcctttgcctattttaaaaattgggttatttgtttgaattttggggtttttgacattcagttgtaggggtttcttacatattttagatatcaaccattcattagataaacggtttgcaaatattttctcccattctgtaagttgccttttcatgttgttggttgtttcttttgttgtgcagaagctttttagtttgatacagtcccgtttgtctatttttgcttttgctgctggtgcttttggtgtggtgtcatatccaagaaatcattgccaagtccaatgtcaagaagtttttttcctgttttcttctaggagttttacagcttcaggccttacatttaagtatttaatacattttgagtttatttttgtatatgatgtaatataagagtccaatttcatttttttgcatgtgtatctccaaaggtaatcagttttgtgaagaaaagtaaaacaaagtgggatggcagggagtaaataaggtgggtgagcaaagcttcactgagaagttgttgttcgagcaaagtacaaaggaggtaaggaaatgatcatatgataagaccattccaggtagagacagcagcaagtgaagctgctataaggcaggagttctggtgtgctcaaaaaacagcagcaagggcagctggagccagtgagtgagaaggagaggaaaatagaaaaggaaaacatagagatgtcgatgcggggatcagaacatataggacattgcaaggactttggcttttgctctgagtaagatgggaatcagtgggttttcaaacagagaatgacataatctgatttattttaaaaggatcattctgacttttatactgagaacaaactataagaagataaggaccaggcatggtggcttatgcctgtaatcccagcactttgggaggccaaggtgggcggatcacctgaggtcaggagttcaagaccagcctgaccaacaaggtgaaaccctgtctctactaaaaatacaaaaattagctgggtgtggtggcaggtgcctgtattcccagctcctcgggaggctgagacaggagaaccacttgaacctgggaggtggaggttgcagtgagccaagatcacaccactgcactccaacctaggtgatggagcaagactccatctcaaaaaaaaagataagaaatgtcttgttaattctggtattccaaataagcaatacagtatatctgctacatattgtatgtgctaatgaatgtcaaaagccttataattttccatagcaatccaactttataatatctttagataggccgggcatggtggcccatacctgtaatcccagcactttgggaggccgaggcagatggatcacctgaagtcaggagttagagacctgcctggccaacatggtgaaaccccatctctactaaaaatacaaaaaaattagctgggtgtggtggcatgtgcctgtagacccaactgctcgagaggctgaggcaggagaatcacttgaacccgggaggcggaggttgcagtgagctgagatggtgccgctgcactccagcctgggcaacagagcaagactccgtctaaaaaagaaaatctttagataattagaacatttgagtgtggattagatattagatgatataaatggtattttttaggtatgagaatggcacggtaatcatatttaaaagaagggttatcagaggtatatatagaagtatctactgataaaattattagtgtctagatcttgctttcaatgctgcagcaaaaataaacaaaaatgggaagactgataaagtaggtaaaattttgataattgttaaagcaggtgatggatgcatggggttcaatatattatatggagttcattatactcttctatctacttttgtatatatttaaaatgcccataataaaaagacagtggccgggcatggtggctcatgcttgtaatcgcagcactttaagaggccaaggtgggaggatcacttgagcccaggagttcaagaccagcccaggcaacaaagagagaccctgtctctacaaacaaacacaacaaaaattagctgagtgtggtggcacatgcctgtggtcccacctactcaggaggctggggtgaaaggatcgctggagcccaggaggcggaggttacagtgagccgaggccatgccactgcactctagcctgggcaacagaacaagaccctatctcaaaaaaaaaaagaaagaaaaatatatgtatataacattttacttggtaattctacctttaataatttatcataaaggaataatcaagaaaaaataaataccaaaaaatagaacaaaaaacaaaaacaaaccaaaaaattattagatattctgaaagataagtaagaagattctcatcttagtgttttcataatagctaaaatttgaacaacctaaatttctaacagttggaaaataaaaactggtataacccatgcagtaaaatacatgcagtccttaaattgttttcaaagactatttaatgatgttaaaaatggtcacaataaaacataaagtgaagaaagcagaatgtgaaattggatacaatattaccacaattttgactaaaaagtacctataaatatacatatatattttaagggataagagtctccctctgtcacccatgctggagtgctgtggtaccatcatagcatgttgtgacctcaaacttctgggttcaagcaatcctcccacctcagtctcctgggtagcttgtgctacaggcaagcaccaccatgcctggctttttttttttttttttggggacggagtcttgctctgtcacccaggctggagtgcagtggcgcgatctctgctcactgcaagctccgcctcccgggttcacgccattctcctgcctcagcctcccgagtagctgggactacaggcgcctgccaccacgcccggctaattttttgtatttttagtagagacggggtttcaccatgttagccaggatagtctccatctcctgacctcgtgatctgccctcctcggcctcccaaagtgctgggattacaggcgtgagccaccacacccggcaaaatgggcagacatctgtaactaactcattagttcatattatttgagagaaactgctctagccgtctcagtacatcctctccaccatgaagtaagctccatgagggcaggaatcttttttttttttttttcttttcgctctgtcgtccaggctggagtgcagtggcacgatctcggctcactgcaagctctgcctcctgggttcacgctattctcctgcctcagcctcccgagtagctgggactgcaggcacctgccaccaagcctggctaatttttttgtatttttagtagagacggggtttcaccgtgttagccaggatggtcttgatctcctgacctcatgatctgcccgcctcggcctcccaaagtgctgagattacaggcgtgagccactgtgcctggcctatttttttaattaaaaaataattttgcggctaggcacagtggcttattacacttgtaatcctggcactttgggaggccgaggtgggtggatcagttgagatcaggagttcaagaccagcctggccaacatggtgaaatcccatctctactaaaaatacaaaaagtagccaggtatggtgaccgccacctgtaatctcagctacttgggaggctgaggcatgagaatcgcctgaacccaggaggcagaggttgcagtgagccaagatttcaccactgcactccagcctgagtgacagagcaagactccatctcaaaaaatagtaataataataataatgattatttttgtagagacagtctcactgtgttgtccagtctggtctcaaactcctggcctcaagcaatcctcctgcctcagcctcccaaagcactgggattacagggacgaactaccgtgcctggccctataaatatttatagataaaagactttgaggaaatatgctaaattattaataatattctttatctctgagtgataggatttcacatcttttgattctttatactctgtttttctaaagttttcttttatgcttacctacttttattaaaacaaatggaagaggggaatgtaaattagttcaaccattatggaagacagtgtggcaattcctcaaagacctagaaccagaaataccatttgacccagcaatcccattactgggtatatacccaaaggaatagaaatcattgtgttataaagatacatgcaggcatatgttcattgcagcactattccatatagcaaagacattgaatcaacaaaaatgcctatcaatgatagactgggtaaagaaaatgtggtacatatataccatggaatactatgcagccatacaaaggaatgagagcatgtcctttgcagggacacggctggaactggaagccattatcctcaacaaactaatgcaggaacagaaaaccaaacaccacatgttatcacttataagtaggagctgaacaatgagaacacatggacacagggaggggaacaacacacagtggggcctgtcagggggatgggaggagggagagcatcaggaacaatagccaatgcatgtggggcttaatacctaggtgatgggttgataagtgcagcaaaccaccctggcacacgtttatgtaagaaacctgcacattctgcacatgtatcttggaacttaagaagtattattttttaattcaaaacataaaaaaaaagagactataaaagtttcaggtttaaactttttgacccagtaataaccctaatataaggataaggaaataggccaggcacagtggctcacgcctgtaatcccagcactttgggaggctgaggcaggtggatcacttgagatcaggagttcgagaccagcctggccaacatagtggaaccctgtctctactaaaaatacaaaaattagatgggtgtggtgctgtgtgcctataatcccaggttctcgggaggctgaggcaggaggattgcttgaacccaggagacagaggttgcagtgagccaagatcgtgccactgcactccagcctgggtgacagagcaagactcagtctcaaaaaaaaaaaaaaagataaggaaatagtcaaatgtggataaagattcaaagattcatgttccagggcattcattgaattgctgggttttatttatttgtttgtttttgttttttgtttgtttgtttgtttttgagacagagtctcgctcaggttctagtgattctcctgccttagcctcccgagtagctaggattacaggtgtgcaccacgcccggctaatttttgtatttttagtagagatggagtttcaccatgttggccaggctggtctccaactcctgacctcaggtgatccggctgcctcagccttccaaagtgctgggattacaggagtgaaccaccacgcctggccgaattactgtttttattagcagaaaagttggaaatgtctaagtgaccaacaaaggaagaatgattaatcgtgatgcatccatattatgcagctactaaatgttttcaaagcatgaaatacagaaaatgctcatggtataataggaagattggtaaatttcatgtttaatatgatttcaaatacattttttaaaaatgaaagattgaagagagacaaaacgttagcaggtttggggtgatgttaatttttctgtttttttttttttgttctccgaattgtctacactgatcatgtattattttataacttaaaaaatttaggctgggtgtggtggctcacacctgtaatcccagcactttgggaggccgaggctggtggatcatgaggtcaggagttcaagaccagcctggccaagatggtgaaacgccgtctctaccaaaaatacaaaaattagccaggcacggtggcaggcgcctgtaatcccagctactcaggaggctgaggcaggagaatcacttgaacccagagggcagaggttgcagtgagccgagattgcaccactgcactccagcctgagtgacagtgagactccatctaaaaaaaaaaaaaaatttagtctggtcatggtggctcacacctgtaatcccagcactttgggaggccgaggcgggtggatcacctgaggtcaggagttcaagaccagcctggccaacatggtgaaaccctgtgtctaccaaaaatataaaaaattaaccaggcgtggtggcatgtgcctgtaatctcagctacttgggaagctgaggcagtagaatggcttgaacttgggagacagaggttgcagtgagccaagatcatgccattgcactccagcctaggcaacaagagtgaaactccgaatctgatttgtatgtaatgagggaagcctgtttagctgtatgtctcccagcagtgctcactagtctggtagtaaaattgaggggggcgaggatggtagtcatctagcattagaagtgcttggcaaaggttacaggagtctgtgttggtggtctacctccatggttgatgtgaagatgttttttataaactgtaaagttctacacgaataatagtggtagtttttaatctatccccatgccactgtcctcattcaagccctcattattcttacttaaacttattgactgcttttcctgcctccatgctctctccaaaccatcttttacattactgcccagagttctttttctgaagcaccggtaagatggtggtggttttttcctttcagaaacctgtgttggctctccatgtctgaacttttaagccacaaatttgaggcctttttattgtttattttattttatttatttatgtatttttggagacagagtttcgctcttgtggcccatgctggagtgcaatgctgtgatctcagctcaccgcaacctccacctcctgggttcaagcgattctcctgccttagcctcccaagtagctgggattacaggcatgcgccaccatgcccagctaatactgtgtttttagtagggacggagtttctccatgttggtcaggctgatcttgaactaccgacctcaggtgatctgcctgtctcggcctcccaaaatgctgggattacaggcatgagccaccgtgcctcgccaaggcctttttgaatgtgatcccaaagtacctttctaccctaatttctgactacatctccatatactgttttctctgtcctcatcatcctacctacctttccctaaatatgcgaggcttagctaaccctctgttcttgctcatgctatgtcatgtaaaacatttgaaggacaaactttggacttacagttagatgacttgtattactgctttggttctgctgttcacaggtggctgtgtggcctttaatatattattttaacctctttgatcctcaggggtttgttgtgtgttttgtttgtttgtttgtttgtttgtttttactaatttcttcatctttatactgttaatacctacctcaaagaattgttagaatttattcagataatgaatacgaaagcacgttgtaactagatgcacagtacacatgtatggcattattttctacctacctctgtcagtatgcttttgacttcaaataacagaaatccaactgaaaatggcttaaacaatgaggaagcaactctggaggtaaggcggttccagggttggttaattcagcagctcagtagcatcgtcctactatctccctgctttgtactctttgttttgttcctttcggctttttacactatggtcttaagatggctgctacagtcttagttgtcacatgaagtcagcaatgttcagatgcaggaaaggaggagtcctattagtatgaccctctttaagggtgagaaaatctctctagaagccttccctcatccccaccccataaactttgcccaatgtctaattcatggaaattgtaccacatgcctaaccagtcatcactgggaagggaaatcagctaatcttcattagcttagaccaatcatgattcactcgctggtactggccgtcacctctcctgaaggaacagatgcttattaggggctctattagggagggaaaagattgtgacagcacgatgtcttcagggatgaccctggtttgttagggcaaggagatgaaaggaagaggtgctaagtagtaaatcagcataaaggggagcttgcttttggtgactcaagatttcaatcaggcatcatacaaaatgctgagagaacagatggggtgggaagaatgtgaaactagttttacattgcagtttcaaagtttatctttatatccaaataggtatgcagtggaactgatgaagaccctgatgataaaaacgcaccctttcggcaacggccattttgcaaatataaaggacatactgctgatctccttgatctttcatggtctaaagtaagaaattcttatttgaatcatatagtaattctgcgtataaggagctgatgctgtagtcttaaagcagaatttcttctccgggaaacctcagttttttgtcttaaggccttcaactgattggatgaggcccacccacatagtcaagggtgatctcctttacttaaaatcaactgattataggtattaatcacatgtacagaataccttcacagcaacaactagattggtgtttgattaaataattgagtactagcttaataattaaataattgagtatagctaagttgatacataaaattaactgttataaccaccttcttaccagaattaacaccttttctttgaactcattctccttaacctttctctagcatttgatgatttgatgctattgatctttcttgaactacttgattttggagcactgtatgttctagattcccttcctatctcactgactattcccttgtttccttcatggaggaaatatgtaatagttaaaaaaaaaaattgagaacctgtgcaactatacctgctatgtaccaagtacttttcattcactcaaaacatatctgttgatcattttaccacctggttaagaaatgacccctggagccagactcccaaggtacatattcttcctagtctgccccttacattatgtgaccttgggcaagttatttaacctcaccatgcctcatctgcaaaatagacataataaaaataccttcctcatagtgttataacagggaaagattaactgagctagtaaatataaagcacttgcctagaacataataaatgttcaattaatattagcagtgatgataatgattaactgagctagtaaatataaaacacttgcctagaacataataatgctcagttaatattagcaatgatcgtcatcatcatcatcatcactatctgccaagtagcattttagccactggggacacagacaaaagttaagtactttacatgtgctctgttcgtaccctcaaaacaaccttatgcgattgttgatgtttccttatcaaggatttaaaaccaagggtcatacgtgttaaagaacatgcttaaaggcgtatagctagggagatacgggagtttaggttcaaaccctatgacttcggagcattactctctagcccattccagtgtcacagtagctaatcactacaaggaaacaggatgacaaaaataacaaatgttggacacgttgaaagatttaagaaatcataaattttttatactttccgttttatactttatttccattctatctcttaggaggcagcagtaatatgatttagtatctatccagctacctaattgtctcaagtgagtaatgtgcatttttaaggactggtgccagcctataaaccacctggtcttcctggtccttgacgatacaaatatagaataccagtctgtgaagagataagtgcagaaaccaagagtaaactatttagaagtgtttatggcagttttcacaataagtttatacctgtttaatcttttaaaacttgggcttctattttgtataataatacaaaatggggcttttattttatatgacttttatttttatttcatttttctagtaaatgttttctgtattttaaaatagtttcagtccacaactcattggaaatttaaaaaaacaaaaacaatccttcaccagaaatagtctgagaagcactagtctagatgagttatttcaatgaggtgctgccccatgcaggaatggttcctaaaggtctatcctcatatccccaacccctccaccccacctccatccagaggaaaggaacaaaatttctgcaacaagattctaagcctctccagggtaggaaccagatattattttactgttttttgcttttcaaacaccaactcaaaccagatattgtttctctttaatgtctatcacagtgtttttagtgagttttctatttgttgaaggtgtattttgtgccaataacaagaattaccgtgttaattcttacaataacaaccccgtgaggtagacaacctgattttgtctcgaggaagagattgagcccctgtgacctatctaaaatcacaaaattagttatgggtagaacttagattttaatctaatttatctgacttctaagatcagtgcttagtttaagaacgttatttaatttcgtttatttaataaaaagtatttattaaatacttataaaagaacaagtctttcttaaagaatacttatttggaacaagtcttaacatgtcttcagcaccttcacttaatattttagggatgtcttcatacctctttcatatgctcaaagcaatgagctattgcaggaattgaatacagtcagtttctgttttttgtttttttcttctgttttcttttttttgagacagagtctcgctctgttgccaaggctggagtgcagtggcacgatctcagctcactgcaacctccatctcccaggttcaagcgattctcctgcctcagcctccccgagtagctggaattacaggcgtgggccaccacgcccagctaatttttttttttatttttagtggagatggggtttcaccatggtggccagactgatctcgaactcctgacctcaaatgatccacctgcctcagcctcccaaagtgctgggattacaggcatgggccactgtgtccagccaaataaagtcagttttaatgaacataggttcatggtgtgccataggttaagtttttatacagttggtattaatcaacaggaaattataatgcaaactgcatatactcttaaaaacttttctggaactgagtggatcttgaaaataaaaatgattgttagatatttcaaagattattgtaaatttccaaattctgttttttaattctttacttttaatcataaagtataccatctatttgaaaacaggtataccacaatgtacctacttcatagtgttgctatataatgcgaagaacaatgcttaacacatcgtaagtatgcgatcaatgtcaccattgccttgatttgtttagcacctttaggcacaccaaagaatacagaggtatcatttgagttttctcattcagtataactcatagttctcctccttaaatagattatgttgaggaattaatgagcttctgccagctgaaagcttttgacagatagatgtttgtttcctgggcgatggggccatcacggtgcctaagtcagttacactaccatcttctagccttgaacattctgtgatctattctgaaagatttgacaatttctattctctaattttcttgcctagagtgtgacaggtgcacaataacttttcatttccatgctgcattatagggtaatctttttgaagacattttaaatgacaattagagatctatgtgagttaaaattcaccagtgttatcaatgtgaaaataactgaagtgacaataaaatgaatagatgccttatactgatagctaagttccaatatgtgcaggtgataacaactaaggcacaccttagttctctgctggtgcctggcagatttctttagacattgataagattcatctgaatttcagaacaggtaatgtcaaaaagttttagaatcagtgaaatatggtacttaactgtttgggggaaaataggatcttccaagtgaatttgataatcttttgttctttccgatgctgcatttaacaataacaaaactgttgagatacaaaaaccaaaagttcacttttattgtataaatagggttctttttcatatagtgataacatagtcaatgtcattttccccatagaactactttcttctttcttcttcaatggataaaacagtcagattatggcacatttctcgaagagaatgcctttgctgttttcaacatatagattttgtcactgccatagcttttcatccaagagtaagtaactatttatacatgtttttgttaacctctaaggaaggtgagagaacctgatttctctagagggcaattggactacaggaaaaaaattattaacagctacatagttatgagcaatttaattttgtgtttcattttgctttagaaatgagaaaggaaatattctgctgatctgcattagaaaaactggggatattatatcctaaatctttattaagacatgcaaggtataaataaatgaaataaagtatcctattaaagatgagagatattggagatggaggaagaagagacagcagatggataaatgagaaagggaagtacctaggcagaaataatgagaagattggggagggaagagacagagaaaaagactgaaagaggcaaagacgaaaattcattacaagatacactgaattcatattgttagtcttgatatcccttctttattccttttcagtatagaaaatcctttcatatctttcccccagaaataaagtatttcatatgatttcagccaaatgagaaaaatctgctgtcatggaattgcagacctattgtatgcccttagaggatggagccaccaaatgcttaaggctaaattagttacagatttttgcaactgtaagcaaaagggaaatcacatgttggtgctgactgcactagctctattaagcagaggactcgagctgaccctagcaacaagtttcccttacctaagttggtgttatgattacatttccagtggtgtcctcatctttatatgtttaacacacattatctttttaatgtaacattttaatcatattcacatttcttcatctcccccaaattaagaagactgacttgttttcaatatactttccttccctgagcaggcttgtaacataagcagtgataattccgaacccttgaagacttggttaagggccaggcgcggtggctcacacctgtaatcccagcactttgggaggccaaggtgggcagatcacgaggtcaagagatcaagaccaacctggccaacatggtgaaacattgtctctactaaaaatacaaacgttagtcaggcatggtggcaggtgcctgtagtcccagctactcgggaggctgaggcaagagaatcacttgaacccaggaggcagaggctgcagtgagctgagatcgcgccagcctgggcaatagagcgagactctgtctcaaaataaaaaaaaaaaaaagaggaagaagacttggttaagaattttggtggctcacgcctataatctccgcactttgggaggctgaggtgggaggatggctttaggctgggagttcaagaccagcctggacaacacagtgagaccccacctttatcacacacaaaaaaactatgttaattcttaccagttttgatgatcaagtcattagagtcctgtttctgaataacacccccatccctgttccctatacacacaacaaaaggatggatttaccccatcagcaactgtgagcaaaatctttccatccataaatctttccataactattttagctataaagtatcagcttggaaagagatatttggttgtgttcgttttctttctctttcttttcttttcttttctttttatttatctatttttggagacagggtatcactttgtcacccaggctgtagtgcagtggtgcagtcttggcttactgcagcctcaacttccctggctcgggtgatactcctgcctcagctccccaggtagctgggactacaggcatgcaccactatgcctgcactatgcctagctaatttttgtatttttagtagagacagggtattgccatgttgcccaggctggtctcaaactcctaggctcaaagcgatctgcccacctcggcctcccaaagtgctaggattaaaagcatgaaccactgcacccatccagttgttttccatgtggtattttattatttattaaactttctgttcagccatgtttttttttttttttttttttgaagacagtctccaggctggagtgcagtggcacaatctcggctcactgcaacctccacctcccgagttcaagcagttctgcctcagcctcccaagtagttgggattacagacatgcaccaccacatccagctaattttcatatttttattagagatagagtttcaccatgttggccaggctggtctacaactcttgacctcaagtgatccgcctgcctcagcctcacaaagtgctggaattacagacgtgagccactgcgcctggcccagccaatgattttttatagtgcttttatttggttttattttggaaactataaagccctatttctaaaaatcgtactgacctggagtgtttttaagaggggctaggaaagaatagggtagtgatgcctttttttgggggggaaatatgacttttattataatgttaaaggaagaaaggtagcagagttagaaaagaaatagcaaaatgggccaggcgtggtggctcatgtctgtaatcccagcactttgggaggccgaggcgggtggatcacctgaggtcaggagttcaagaccagcctggccaacatggtgaaaacctgtctctaataaaaatacaaaaattagccggccgtcgtgttgcatgcctataatcccagctactcaggaggctgaggcaggagaattgcttgagccaaggaggcggaggttgcagtgagccaagattgtaccactgtaccccagcctgagtgacagaatgagactccgtctcaaaaaaaaaggaatagcaaaatggagatacacatacatagatgtatgtatgtgacaattctgaattagaagactaagttaaagtatttttacttgttcacctcttctactggtacacattgagtgagcttacattatttgtagattgtctttgacaggtttcagagatgggtaagaataataatctttggcaaggaacagaaacccttagggcagggggatttggggtgggggaaggaaaaaaaaagaagaagaagaatcttggctgggtatggtggctcactcctataatcccagcactttgggagtttgaggcaggaggatcacttgaggccaggagtttgagactagcctgggcaacatagggagaccccatttttataaaaaaatttaaaattagcccggtatggtggtgtgcttctgtgatcccaactacttgggaggctgaggtgagaggattacttgagcccaggaggtcgaggctgcagtaagccgtgatcgagcctctgtactccagcctgggcaacaaactgagaccccatcaccaaaaaaaaaaaaaaagaaagaaagaaagaaaaattcttatgttgccaaaaacaaaacaagcttagtggtaggactgatttagtttaaaggagatttctcaatcctagtactattgacattctttgttacacgggggagagtaggctgtgcgttataggatatttagcagcatccctggtctctacacactaaatactggtagcatcctgatcctcccaccagttttgacaaccaaaatgtctccagataatgctagatgtcccctgcaaggtcagattgccgcaggttgagaaccgctgatttgagagcagaatttgaatgatgaagtaattctctgttgacatggtgttagagttccaaaaatgactggttttgggggccactaactgatgttactctttatccaagtgttacatgtatcccagaggaaggtatgatataggatagtgtttcccatagcatgttcctgaaaggtctagcacctcccgtaaacacgcccccccaaaaaaagtctgtggttaaatatgttgaaaagtgctacctactttatcctgtttggagattcaaaatgcaggttaactgagaatcatgtttaactttttgtaacccagaatttctcaaacttatttgatcacagaaccttcttccatgcaatacacactcaaacactttatctattgacatccatatcttgcaaaacagcagtttaaggatatgataattagaattttatttctccaaagtgaatagtgaggtttcttattgttgttactgctttcagtgcataaaataatgcttgcttaaagaataaaaatttttaaatgaaatctttttttttttttttttttttttttttttgagacggagtctcactctgttgccaggctggagtacagtggtgcgatcttggctcactgcaacctccacctcctgggttcaagcgattctcctgcctcagcctcccgagtagctgggactacagccgcgcaccaccatgcccagctaatttttatatttttactagagacgaggtttcaccatattggccaggatagtgtcgatctcttgaccttgtgatccactgccttggcctcccccaaagtgctaggattataggcgtgagccaccgcacctggccctgaaatctacatttttaaactattctaatagacttactgatttgatttgctaatgagttttttcttgatgtggtaaaatgaaaactttctctgttgccacctctttaggatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagaggtaaatgattgttttttgtaaattatataattgtatacttagtaaacactttcatggttttggacaagttgcttatcccctctgggctttaactgcattttctctaaatagagacaaataataccatgtctgtcttaagagttggaacagatgacttttgagatgtcttctaattctaatttaaaaaaaatttttttttgagatggagtctcactctgttgcccaggatggagtgcagtggagcgatctcggctcactacaacctctacctcctggattcaagtgattcttgtgcctcagcctcctgagtagctgggactataggcacgtgccaccacactcagctaatttttgtattttttggtagagatgggatttcaacgtgttggccaggctggtctcgaactcctgacttcaagtgattaacctgcctcagcctaccaaagtgctgggattataggcgtgagccaccacgcccaagcaaaaagaatttttttatagagacaaagtctcattctgtcacccaagttagagcgtagtggtgcaattgttgctcactacagcctcgaactcttgggctcaagcagtcctcctgcctcagcctcctgagtagctagagttacagatacgagccaccacacatgctcctaattctaatatgttaaatgtatggtttatttttagcatttgaaataccatacacaaatacatgtccgatctactagagggcgcaacaaggttggaagaaaaattactggcattgagcctttacctggagaaaataaggtactacagtattcaaaaccatctctctccatactatatgtagattcttgaaagttcttaatatcttggcaaaaaaatgtattctctttgttgtggaataccgcttttcttctagttttgaggtatattagtttgtatgtgtgtaacaccctttttgggttgtagcttagcttgtactaaaagatgatatttttaacttttcatttgatctacttttagatattggtaacctcaaatgactccagaatcagactatatgatttgagagatttgtcactatccatgaagtataagggttacgtcaatagcagcagccagatcaaagcaagtttcaggtaaattggcaatgagatgttcccaaaagagatcaggacatttctcccctagttccatttttccattggtctatgccttatgtttaatggggttcttttcacttttgcaagtagtagtttattatcatgcaatacgtaccttgtccacctatatagtatatagaattcgaattgaccctgttctgcaaatgaagaaaccaagactcagaaaattaagtgattggcctaaagtcatggttgtagagccaagattatgaagactctcatctctagagtttttgcttttgtacctttgtttacgcttttaagagggggcttacggctcatcccgccactcccctccctgccccattgtcttgaaccttttaggaaaggaaggaaccttttaggattctaagaaagcattttaacaccccacagcacagggtcttgtattcaaaactttacatatcattattatttaaatttctaatttgggttctggacactctcctgaaatagggttagctaccttttcttctttctagccctcttcttttgccgttttcttaccagttcttttttcttgaattatacattaattaattcaattggtaaagtattctgctcctgtctttcacaccttaaatcatcattcctcccaacgtggattaactaacatcacagttacttagagctttgatgcaaatacaagtgccaggccactacatcacacgtacacatttagaacatctagagtgagaccatgggtctacatattcaacaagacccttcaagtgttattttaggtatcacaaagtaggaagcactgataaaggaaacctttaaacatatacacacacacattttatttgcttttcctttctccccaaaattcagccatgattttacttacctcgttagtggttcagaagataagtatgtttatatctggagtacctaccatgacctaagcaagtttacttcagtcaggagagatcgtaatgacttctgggaaggtattaaaggtaagtacatacttgcttttgtgtgtcttataagagaatcaagttacagtggatatatactagaagtaaattcatgaccggacacagtggctcacgcctgtaatcccagcactttgggaggcccatacgggtgtatcacgaggtcaggagatcgagaccatcctggctaacacggtgaaactctgtctctactaaaaatacaaaaaaaattagccgggcatagtggcacacgtctgtagtcccagctacttgggaggctgaggcaggagaatcgctggaacctgggaggtggaaattgcagtgagccgagatggcaccactgcactccagtctgggcaatagagtgagattccgtctaaaaaaaagacaaaaaaaaagaagaagtaaattcatttaggcattattttagagaggcagtttgacaatgataaagtgccttgcatttggctttgcttgttttatctatactaaggaagaactttggtctaaaatttgagaagtcagggaatttcagaacttatatgtgattttttttagaaaaatttttgggttttaaatcactcttagttacttctatgttagtttttaaggatatttggcatataacatacactatcgtgtttgtcttggtatccaatttgtcagttatcctgaagtaaattttttccacagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtaaatctttacttgtcctatatttttttctagtcagcacttagtagcctcatttatctcatttgagtataataaggttttcactagtataaagaatatttcttttttcttttttcttaagacagggtcttgctctgtcacccaggctggagcgcagtgacgcagtcacacacagctcactgcagcctcaaccaccctggactcaggtgatccttccacctcagcctcccaagtagctgggactatgggcctacaccaccatgcccagctaatttttgtattttttgtagagatgggatttcaccatgttgcccaggctggtctcaaacttctgggctcaagcaatgcacccacctcagcctcccaaagtgctgggattacaggcatgagccaccaaagaatatttcttgtttgcaacttaatggttgtcagatatccatttctgaacttttcagtaatatatttcctcaaagttttacctgttttaaattcacctgagaattaaaaatgagaaatttgggcctggtgcggtggctcacacctgtaatcccagcactttgggaggccaaggcagatggatcacgaggtcaggagatcgagaccatcctggctaacacggtgaaaccccgtctctactaaaaatacaaaaaattagccgggcatggtggcgggtgcctgtaatcctagctactcgggatgctgaggcaagagaatggtgtgagcccgggaggcagagcttgcagtgagctgagatcgcgccactgcactccagcctgtgtgacagagcaagactccatctcaaaaaaagaaaagagaaatttggatgttcataactatgggtaaccattctctttagagaagtgcaaacaatatatgcaaatgtaaaacttctttattacctgtctctcctactagtctgtaatctctagaagacagagacttttcatgtcttatttattgctgtattgccagtgtctctcacaatgcttgcctacacatagtaggtgcttgatgaacatgtgctgactaaatgaattaaacccaaatgaagcagggctaatttttctacttgccacaagttaacagcttcttgagataggtggctatttacaagtttgtaatttcttgccatttgtagcatatatgctttgagaatgaatattaattccagttatatacaatgctcatattaggaagggagaagaaactgtcagcaagtaatattgagtgccaatcagttatataaaaatctgggccaggtgcggtggctcacgcctgtaatcccagcactttgggagaccaaggcaggcggattatgaggttgagagttcgagaccatcctggccaacatggtgaaaccccgtctctactgaaaaactgcaaaaattagctgggcgtggtagtgcacgcctgcagtcccagctactcaggaggctgaggctggagaatcgcttgaaccagggaggtggaggttgcagtgagccgagatcacgccactgcactccagcctggtgacagagggagactccatctcaaaaaagaaaaaaaaaaaaaaaaaagaccaaggtgagcagattgcttgaggtcaggagttcaagaccagcctggccaacatgttgaaaccctgtctctactaaaaatacaaaaagtggccaggtatggttgcacacctctgtaatcccaggaggctgaggcaggagaagtgcttgaactcgggaaggtggagttttcagtgggctgagattgcaccactgtactccagtctgggtgacacagcaagactctgtctaaaaatatatatatatggcaggcgttgtggtatgtacctgtaatcccgggtatttgggaggctgaggcaggaggtcttgagcccgggcaacatagaagaccagcccgggcaacatagaaggacacccaactcaaaaaatatatatatgattcttttttaatttttaaatcgattgcataatagtttattgactgtattgtctcatgctacagattacaaacaggtcataaagccacaggaatagatacagtgtacaaagagtgcttctaaagtatttgaatggtaaaaagttatcaagtactttaatctcaagtaatttttttgtagtattatttggactatctactccactcatgacacttttccttctgtctgtgaagaaaaattttgataacaaagatgaacttcagtctagcatttctttcagtacaagatacaaaaataaaccaagttagaatgattaaacctttactaaatgcctgtttaactgctgtctgttttctttttctttccttctcagaatcacatccagcttctgtcttctaacttaagtcatttacgttttttctttttttttttaacttatgaatgaatgaatgaatgaatgacatggtgtcgctctgttgccctggctagagtgcagtggtacaatcatagctcactgcaacgttgaactcctgtgctcaagcaatcttcctgcctcagcatcccgagtagctaggactacacgtactaccatgcctggctaattttttttttttttttctttttgctagcaatgagttctcgttatgttgcccaggctggtctcgaacttctagcctcaaaaaggttagtcctactttggccaaagtactgggattacaggcatgagacatcatacctggcctttttttcttttcttttcttttttccccagtgctacctttttacattccatatacttcccctgcatattccacaggaaattctagcttttaaaacaatttgaggaaaagtaaaaagtacagggttttttttaacttctcaaaaatataccacattaacaaggttcagttaactaactgggtccttttttaagaggcacaaattttagtggattgtactcagatttgtgtttgtcattttgtacccatgtaggtgtagtctaagaataagctctcttaaacccaaaatgtgggatcacaaaatatattcaattcccctctctctttgttcctgacgtgtttggcaattcaagcctcaattttccttatgtgtaaaataatgatgataacctagtttatagagtttcaataagaattagatatgacatgtataggctgggcatggtggctcatgcctgtaaccccaacattttgggaggccaaggcaggaggatcacttgagaccaggagtttgagaccagcctggacaacatagcaagaccctgtcttcacaaaaaattaaataattagtcgggcacagtggcgcatgcctgtagggaggctgaggtggaaggatcctttgagcccaggagtatgaggttacaagaaagctatgatggtgccactgcattccagcctgtgcaacagagtgagactctatctaaaatatatatatatatatatatatatatatatatatatatacttgtatgtgtaaaagtgcctagcaaaatgcctggcatgtagtaggcattattgttatcattttcattattattgtgtcttacaaagcattttatatgtatggtgaattattttcttctctatcctttctcatattcctaagttctttgctgctgctactactgcacagcactgctgtgagatatgccaaaagggtggtaaaggaatgttcaaaggcttaggatatgtttttagcacatctaagtgaaaccattttgtgtgactcatcctgtccacaactttccaattaaagtttggattattttcttcttttttaaatctcaaattaaaatctcagttttcacctatgtataatagagttagttaacactgaatttttttattaagtgcttttatgcaactggcaaatgtaagaggtaagcatttatgccattcagcatagttatatagcttttcagtaaggaccatatggcaaaaggtgctgtcagcattcacacagcaaacgtgtgtacttcatttcatggcagtttcagtatgtctgctatacaataaaccttactggcaacctcgctagacacccctgttagcaacagacttgcccagctgatccgattctgccagcactccagtcctggggctgaatgacacactagcttcttgccatgcaatgaagcattagatgacttagatgcctaggctgcctaggaataggtccaagcatccaggccccaagagactgtaatatcctcaagccagggaaagaccagctaagacaaggtaagtgaaagtgagcctcagagcagaggagagattcagcagaatgaaagaattacaggagccagccagaaaaggagactgaaaaggtggggagatgatcttctcccctgaagctggagggtcatgggcatgtgataattgtggcagcaggcttcatattcctttaaaaatcaacttaaaactattttttatacttttaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaa

SEQ ID NO: 5852 - DNA, 103794 bp, human
attgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtaagtgactgcagctatgacaggaagccgggcatcccaagccccccgcatctcctgtgtcttccccctacacccctcccaggtcccgctgtgtccgccaccgctgttcctccccgtctcactggaggacttcagaacccagacctggggcttcttagggcggggtgactcggagaagggggagtcagccacctcgggcagcctcccggccgtttccctactgaacggtcccagggtcggtctcggagcccgtttctcttctgatccagccttctgtgagggggaacagcttacgtgcctgagtcggagatttgtatctgtggggttctgagcttacctttcaaacatccgttttggcctcggggaccgtagattaaaggagcagtaacaggagaaatgtaacttgtagttttttattctcccgtttaccgctaacttacctattcacttcagaggtggctgtaactctcccctatttgccgtcctctttttcttgcacacagcgaaaaggagcggggggaaggttgggtatttgcttaagaaagtcctctagcgaatgtactctagatcaacagtgttttattaaaataacaccttatcgtgaggtaaaggaaatcgaatacacggtccctattaggcagaatgcggtctaaaaggatggccagacagaagaaatgtgcacaactgactgcagagggacaaacaagtgctgagtaatctggtgattggaaggagagccccagctttgtgttctttatctaattctgcaagatgttttagtggtgattaatatgggtgattctgaataggaagtacagtagttggaatgctcgcttgactaggacttgtatttacttacccacttctccacttttcaaagttggggtagtgctttaaagcgatttcgccgaactcccctacgaatgtacgtggaaatagaggcagtgaaatatattttcatgctgtaagaacttgaggattggtaaaatgtagatgttagtataaaggactaatatggttcgagaagttcactgccttcaattctcacacttactccgtgggagtaataacccgctgtgatgcaagtatagttagccatgcatgctagaagtcattctaaaaactaatgtatgtttatacacaatatgcaccaaaaagttacagtaataaaatcagaaagcaatgtacgttggtagatttcagatgtttgtctttccaccaaccttcatgtcactgttgtgggattttggggtggcagtggccaatcttgagatgacaccgaatctccttcaagttcaatatctgagacaagtttagagctaggtgtagagcataggaaatacatttgggttttgaaatgtattggacttccgtgaaacttaatttttgtgtgtgtggttttcccttcaaagtaatgaactgacaattcagattgaatgagacaccaagtcctttggtacttttgtgtgtgtgtattggggtgggggagggaaatcatcagtttatgagctgatcagtttagaactactctgtggatattgttctttccactgaataagtttaatttcaaaggacgcaagttatatcaggacctgtgtaaactgtctagtccagtacctgggcacagagaaagcattcaaaatgttcatgcttttctccttcctttcttggcattggcaaatttgttaactttacacaaagcttattttgggagatatatagaacttggacctattttacttatctaaaccggatgagtcattttgatagaattgatagagtcacttcttccctcatgagataatacagcttctcaagcactttgatcctctgatattaggtgaaaactgaaaaaggtttttttggaactcagctttctaattttaactttaacctgcccaattactaagtgtgttgagttctatggataaaactacagggtcagtttgtggatttcagggctcctttctgtattagaggattggaaagacaatagactaatctggagaattgcatctgaaaagaactggcagcactgagggcagaaaaaggttagcatcatttacattttcctctatcctttgtggaaggttgtatcatttgcataagacaccgtgaggagatctgggtgggcaacttataacctagaaatgtagtgagaaatcttgatttgtggaaacagattgccttactagatattggtcatcagaaatatgttctgttccttcatatgatctggagtggcaaactatacaatttctaaggttaatagactgaatttgggcacttcagaaatgttccttgctgttgtgtgtttgggagtacacagactatgtcaacaaattgtagtaaactgaataggcagtggagacttatctcatgttttgttaattagcacaatcctaatacacaagctatttcctaaaattaatttatttcttgcattttccttccaatgatgtcttcggctttgttaatctactctttgaaagcaaatttaataagttaaaaatcagcccagtttttttagagacttttaattccagtacagcctacttttctacagtggcagatgatcttcacttgcccagctttgcaatatatgccgtatttataatgcttttttattgatattttaggtcaggttttctttattttcttttttcttttctttttttttttttccaagatagggtctcactctgttgcccaggctggagaggtggtgagatcatggctcactgcagcatcaaactcctaagctcaagttatcttcccacaggtgcataccaccctgctcagctaaaggtttttttagagatggggtcttgctatgttgcccaggctggtctcaaactcctggcttcaagtgatcctcccacctcagtctcccagggcgctgggattactgtcaggcatgagccatctcgccaggcccaggttttctcatttttatcttcatttttacatatgaggaacatttttttttttttttgagatggagtctcgctctgtcgcccaggctggagtgcagtggcacgatctctgctcactgcaaccttcgcctcccgggttcaagagagtctcctgcctcagcctcctgagtagctgggactacaggtgtgcgccaccacgcccagctaatttttaggagagacggggtttcaccatgttcgtcaggctggtcttgaactcctaacctcatggtccgcccgcctcggcctcccacagtgctgggattacaggcgtgagccaccgcacctggcctaggaaccttagactcagagacggttaagtgaatttgtcctaggagagagcttttaagtggcagaactgggatttgaaaccagctcttcagactcctagtccagtatttttttttttttttcctgtggagggcgatgagagcagtgacagagaggtggacagagatcctcccctggtaaattctggagtaaaatgctttaggaccaagttgctgaattgaactgatacatctccattaaaaccagcagcctaaacttttttgttctcttggcaagaaattccactttctttcagcaacgtgtatttttgttttgtcagataggaattttgcaagatcatagcctgttgcagctagaagggacatctagttaaactccttcgtgtaaaatgttgtgaaaactgaaacctagagagagaaagcaacttgtaaaagctgccacagcaaattaatggtggagctaggtctagaacccggatcagtttgactgtctggcgttctttctgctactgggctgtcttttgatagagcaggaaagagaagaggaatcgtgtggtacactagaaaagagccctgcactgtgagtcattttatttcctcatctttaaattgaggggattacactcttgagaacccttccaactctaaatgtctttatattgaggtttaatagtgtgcttgtattgataagcttttgttcttggtaaatctttcgtgattttttttaatcttttcgtttaacttaatggtatttggtacatagttcaagacccataaatttgaaattaagtatttactgggtaaattatatatgagatgaatgcccctgctaactcatgtggtttatacttacacatactaaaggctggcactgagaacatgttgtaaaaataaatgtaacattttcagcactcttttttttagtggcagccaaaatatttttgaggccttggaagaaggatagaatcataacatttttagagtaggaagggactggagatcattttagcccagccttcccttttaactgaaagtgaaatttagggtctgagaggggaagtgacacattgctaataagggcagacttggaactagagcccaggtctcttgattcctcacttataccatgctaccatgtctgcggaagaagggaaagtattgctggctattcctgccataggtttctggcacttaccctattagctgggcttttaagatggtttacttgactgtttcttcataccttgcctatcagaggtcttgaactattttagaatcctaagttttgcttacgagttttttccaagtgaaagtgaaaaacaatggcaaaatagcttgtctaagaacagtgattatttgtattattttattcttaggcatttagttagtattaactgcaatctaccatattcagataggaataatgataaaatcttaagtcatgggaactgagaccaaactgtcctgaataattgttaggtctgaaaaacaaaaaggtgtgtagctgcctttgttgaaaactcagcttctcactttacttaggtgtcagaaacatttctctctgaattgaaaattgatacaagttttaatttaaaaaatacctgtgcaatatttattactttagggaagtttccttaaaaatggctgtttgttgatgagttgacatttgatcacaaatttgattactgaaggctttaaggagtgatagaagtatatttacaaatgctgttttatcgcactcatgtaacatcatattgaagtgagaaaaaacaaccctctacatattagttagtaaattcaagttctaaatttagtgacatccggccgggcaccatgactcacgcctgtaatctcagcagtttgggaggctgaggcgggtggatcacctgaggtcaggagttcgagaccagcctggccaacgtggtcaaaccccatctctactaaaaatacaaaaattagccgagcatggtagcacacacccagctacttgggaggctgaggcaggagaatcgcttgaacccgggaggcggaggttacagtgagctgtggtcatgccactgcactccagcctgggcaacagagcaagactccgtctcaaaaataaataaataaacaatttatatttagtgacatctgactgtcagttggtaactcatgggggtaggatagtccatagtggcatggcaatttgggggctcaagttgaatctgtataaactcctgtaaattggaaactgtattctcttcttgtgataatctacttcataagataggacagataaaatttgtgttgtttgttttttgttttttgtttttttttttgagacagggtctcactctgtcacccaggctagagtgcaatggtgcaatctcagctcactgcagcctcgacctccccaggctcaggtgatcctcccacctcagcctcccaagtagctgggaccacatatgtgcaccaccacgcccagctaatttatatatatatatatatatatatatatatatatatttttttttttttttttttttgtagagatggggtttcaccatgttgcccaggctagtctcaaactcctgggctcaactgatccacccaacctcgacctcccaaagtgctgagattacaggtatgcaccactgcacctgtcccttgattttaaaaaatattaaaaacctaaatagttttaggatgtgaagtatagtggtggtcttaaacagaaaataatttctaattattggtattttagacttactgtctaacctttacattacccaacactccatgtgtttgtactcttaagttcattgttaagactttgacagaatcaggtgaatttgccaggcaagcacctttaagaggctgcttgtttcctcctcatactctgcaattttgttagttacttcctggggtagtagtggaggtggaggaagggagtataaagagatcatgcaggttgtggtgatggaggtggaagaggtaaaggtagccccagcagtaggtatagagaccaagttacagtgctgcttcctggggcatggataactgagataagacaaatcccatcattttgatacacatgttcacagcatgaattaaataaccccttctctaagagattaataacctataagaaatacctcaaatcaaagttaaagtaacaaaaattgtaggtactttatgatgtcctactgatatttagcttgaattgataaataacctatgtttctcatttctatccatagttaggctaatatctacaaactttcacaaggactgttcccctctcactgttggatattattcagctaaccagctaaacctttaatagggtgctttccttactcttcagagtgaaactctttctattcccttatttcaaactcagcagtgtttgtgttagtctgtcatctcatgattcaaaaccgaggaaaaagcacctacgacataatgtgggcctcatacctgatggcaaccctgatgtttttcctcagtcagtatacaaatttatcttggttactatagcaaccagtctatcagttattcttctagctcttttgccttctctcagatactaggattaccatataatcaggttctgccagagcgcttcaggtcttagagttctattaccagctgcaactgtctggcagttcacagtttggcattccatcagagtcagttgttttttaagtccacaaaacctttttgtctccaaacctttttaaacattttaaacatatataatttaacaaaaacatgtttaggcagcaatttcctcatactaattttctcaatccagtgttagtcattgccctgaagattgaatgcattgcatcactgcatccaatagccatccctttataataacaagtagaatcaatttccagatcgagggtgaccatttaggaaatatatttgcaaatgtgattttagactcagtatcatcacaaactagctaaaatgacttaaaagcatcttgatcatcagcagctaccaaataatccagcttttaacaaaaatgatttctataggttgtagaaagaatgtttggcctttagattaattcattttaatttgagaaaactgtttagaaaactaataggaagtgttatcttttgtagcccttgaataaacaggaagagaacagtaaagactgaatagttgtatgggtctttttttttatatttatttgacatacttttttaactcttaaaaatctcagaattcatgtaactaaaatagttttaaattataaatatgtttacctgttttggtcaaaacaaggattggccaggtacagaagctcatgcctgtaatcccagtgccatgagaggctgaggtggagggatcacttgaagccaggagtttgagaccagcctgggcaatgtagcaagacctcatctctacaaaaagtttttaaaaattagttggacatgatggtgcatgcctatagttctagctatttgggagattggggcaggaggattgcttgggcccaggaggtcgagggtgcagtgagctatggtcacgccactgtactctggcctgggcgatggagccagactctgtctcttaaaaaaaaaaaaaaactatagttaaattatgataatgcttcaaggaaatctttaattgtacaaatagacttaagactggtttcactttctccacagagtcctgatctttaaaatttttcaaagggggagtcaggtttttaaaaaatctgaggatgaaatataagattttttgaaacttctgagggaaaacttgaatggtatttttttttattatactttaagttctggggtacatgtgcagaacatgcagttttgttacataggtatacactgaatggtattttctaataggtatcctatacagaacaagccatacctgtaacaagctatctatatctgtataaaacctacttggccactactaattgtaatagactattccagtacaaaactcattgaaccatgggcattcttatgaaccacagatcaaactttctagagaacctataaatagtatgtagtgctgtatgcaaactcactgtcccaggagcaagcatcctgattactaagcaagctcaagagaagaggtgggagtattctttctgacattgttcttgaactggtaagaatagctgtggatgaacttaatatccatagtcctcttttaattctgtgcctgaaagtatttattgaaattggaagactaagggaatcatctttctggttattagcagtactgttaacaattgaattttttttttaaatctgtcttttaaaatatattacctatccatgccaaactaaaatggcaggtggattgaacatttcactcagccccaactccacccctttcactgccagctttttctttcctagcatagtcaatgtcattagtacagagatttcctagtataactacttcttgtcccttaaaactgagaagggtcagtgatggaagaaatataaagggtgggaacttttggaaggagtaagggaaaaattggttgcattggatatggtggacaagttggtaaagactttagtgttacaggtggtgcttagtcattggattagtgaaagatgggtgagcagaatgaacaagtagcttgataaaactagtagctttgtgagtgaaagcaagtagatttgtctgtattttgcaatgggtattttatctttattagcttggcttaagggttaaggttaatgattgagatcagtcctttttcctttaagtgcaccttactgtgcctattatgtcccagatcatagcccttagctgttgacttttaacctttgccttatttcccagcatagtccacagttatgtctagcagtgcacacaaggtttagttggggaggcgggtggtgagtaagcatgctctgtggtatctactgcgcttcacaattggttctgattttgaacttcctggttctctccaatctccagtcacccttaaacacacacaggtaccagttcctataagaggaggtaggtaagggagctgaggcaaagagagtgctttggatgtataggatcttcataacttgaggacatcctatacccagtaaatattaaatgttaacagtaaaaccttgggtggtgttgccagttatcctgcattcctatcagttccttgttaccaacttttttttcaggaatgaatgtgttcacagtaagaaagaaatattatagtgctacatgttacatgcaaagaacgataacaccataacaccataatgctaactaacggtgggcatttgttttcaaagttcttttaaaaagttactgtttcaaacaatgaaaagcagtatttttatgcccttcattttaagctttgacataattgattacggcatggtagccaggtcagaaaatgaccttgcttctgaaaaagctggaatcccagacactgttcactgcatttcaaagagttatggtctttgttcctaagggaaaccccctcaggatatgagccattgctgatttgggtttcagtgccgtgtcaaaaagtcttaatcccagatttttttttttcctacaattgttttatagattgttgtcagttgcttagttaggccacagtactgtattgtgttttgtttttattttagtataactgattcatttttttggccacaagcctctaactagaaacacaatgtttctttttctctttcccttcaaatgtgttttgtagcagtcacagagagtgactgctttgtcactctttgtgactacctacctaatcaaacctctattggctttcaaactaatgggaaaaatgtattcctaatagctgggtaattacaaaaaaattaaatgattagtaattactgtttaagatgtaaataagattgaacaatttgtaataatagtaaagggcttaaacttgatctacatagtgtgttctgtaggtaagcattctagataattgaagatttttgtagaatatatatatcaagtcattgatatatatttctttcttttttttttttttttgagacagagtcttgttctgtcaccaggctggagtgcagtggcacaatctcggcttactgcaacctccacctcccgggttcaagcgattctcttgcctcagcctccggagtagctggcatgccaccaagcccagctaatttttgtatttttagtagagatggggtttcaccatgttggccgggatggtctcaatctcttgacctcgtgatcctcccacctcggcctctcaaagtgctgggattacaggcatgagccactgtacctggcctgatatatatttcattagaaaaagaatgtagaagtagaaattcaagtacataaagcatagaaattaaatttagaaaataaagtacttaatggcagattttactgaaatatatttgagtttttgttattcatgatattgtaggaaaacatgaataattaaaagctgtcagttacacaacaatctcaggtcagtcattagtttaccatcaaaacttttatcaaagataataacagtaggttttctttaattttaaaaaataaatagtttggtttgagttttgttcctctgctcatctttggtgatgagcagtgaactcaaaagaaggaaaacaagaaatcttgaagtctgagtagttcactaatagaatttatcaatttaaatttttaaaaaggggggctcacgacaggtgctttagaatgctagtttttatttagaagttactggcatttacttttaaaaattagtaccccaccaggtgtggtggctcatgcctgtaatcccagctacccaggaggttgaagcaggaagaccctttgaggccaggtacttgagaccacgctggccaacatagtgaaaccctgtctctaacattttttttttaaacttaaccaggcatggtggtacttgcctgtagtcccagctaggtgggcgtagagggggattactggagcccaagaattcaaggctatagtgagccataatcacaccactgcattccagcctgggcaacagagtgagaccccgactcttaaaacacacacagctgggcgcggtggctcatgcctgtaatcccagcactttgggaggccgaggcgggcagatcatgaggtcaggagatcaagaccatcctggccaacatggtgaaacctcatctctactaaagatacaaaaaattagctgggcatggtggtacacgcctgtagtcacaaactagctaaaaatgacttaaaagcatcttgatcagcaacagctaccaaataacccagcttttaacaaaaatgatttctataggttgtagaaagaatgtttggcctttagattaattcattttaatttgagaaaactgtttagaaaactaataggaagtgttatctttcttttgtagcccttgaataaacaggaagagaacagtaaagactggatagttgtatgggtctttatttttaaaaagccatatgtctttctttttttatatttatttgacaaacttttttaactcttaaaaacttcagaattcatataactaaaatagttttaaattttaaatatgtttacctgttttgctcaaagtaaggattggccaggtacagaagctcatgcccagtgccatgagaggctgaggtggacggatcacttgaagccaggagtttgagaccagcctgggcaatgtagcaagacctcatctctacaaaaagtttttaaaaattatctgggcatgatggcacatgcctgtagtcctagctatttgggaggctgaggcaggggaatcgcttgaacccaggaggtggagattgcagtgagccgagatcgcaccactgcactccagcctggcgacagagcgagactccgtctaaaacaaacaaaaaagaaaaaaccaccaccacacacagattagtactccatttaatgttttaggtaacttacaaaaccatattaatatggccaggcatggtgtatcacacctgtaatcccagcactttgggaggccgaggcaggtggatcgcttgaggtcaggagttccagatcagcctggccaacatggtgaaactccatctctactaaaaatacagaaagttagccgggcatggtagcacacaggagctcctccagctactcggtagactgatgcaggagaatcccttgaacccgggaaacagaggttgcagtgagccaagatcacaccactgcactccagcctgggcgacagagtgagactccatctcaaaaccaaaaaaaaaatcttagcactttagcttgataaagcttctgtaatacggcctgtagcccaacatcttgtttactttttcaaaagtaacagtgatctagcatgattgcattagatattgatttctctaggcaggcataaatttagttatctgtttctgtcttgattttactggaaattactttaagtcattaatagatttgacttttattctaacctactttaacaaattgggacatggtgatatagctgccttaccttggtgttattgttttactgcaggtatttattgaatggttgtgaatgtgcagaatagaatgtttttagtttggaatccttgagtaggcccaggaaagtggttttctgtttatgtcagtaaatacattatcaagctgttcttttaggaatatggcataaagctgcactacatacatcatttttgaaaaatcaggttgtcattttagataagatataattgtaagaaggtccacttgaagttttgtaattaccctgtatgtgaacagatgtatatttcacaacaaagtttcctttgatttcattaaagatcatttacaaatattgccacaaaacctttcaaaaaacatagggccattgtgccaaattttctcactatttctattaatatcattgataaaataattattagttaattttagatgtaatctgctatgctttcatagtatttaaaatttaaatgtcctttcaaaaggtaataaaagtaataattcacatcttgaagattcagttaatatcctattggataattgtcataactattctcagctttttgtgaatgttgttaataaaccagtattgctttgcatccaaggaaattcgagtgatttctattttctgctgcctagttacctgagattttgggatgtactaggaaaatcagactaatttatgattgcctagcacttatttttttcctgctgtttttagacttttcaggtttagttggtattatcacttttggtagtagtcaacttaaaattattagtagtcaacttaaaataggactgtgagaatgagagtggtactgttacaaattatttaggtttgaaaggccagcagatgatttttctcttagatgccatttcttcaatttgagtagcactgtctttaggttgaaggtgcttatatacatttcaactccagtgtacagtattacataccacattttaaaagctgtgcacttaaagcaagatttaagaacaaaggagaacagtctcttgttctctaaacttgaagtgtttttaatttttggttcaacctagggttagttttgtttgtttttatttttgttttttgcttcattttttgttgtcatcatttttctgcctggcctcagtgggcccaagaaagagttcttgttaagtgtttcctgaggaccagacacgtgattccctgtttagacttagcacttcagtgtcggtcttagtttgctatcaaatcttactgtttcaacttgctggactttagaaatcaaaactctttaattagttgcttactttaatgactggctaagtccttatctatgctcataccctgttcacctcaaggaccttagaatcctagcgccttctttgtacaggcaagctattctttgctttgcttgattcagttccttggtgcactgcttaagctcatcttacttttatattttctttataacaaaggatagagggggataaaaacaaaatcaagctgtagggtaatttcctggtgaaccttttgtagtcactttcatgtaagaaaaatgtttcccaagcaaccagctttattctagctgactcactttgtactccctccttccatgtcattgctcctttttacctctttaggagtctgttaggaattttgcaacctgacaaaaggcttctgcagagccaaccacctttttttttcctcagggcctgaaaaaaaagtgagtcttcctactgacaggaaaataaaaagagaccttgttagtcaatttttttctgtatgttcaattgttctggtatattcttttccttgagtataaagaaaagtctgaaaataatggtaaaagtgtgagattgctctgatatttcctttttgtactttaggaggtggttctttgagttcctagttgtttagttgaacatgaagcaggtggcaaatgtaagtttagtctacacactgattccttcctgttcgcagaagggttcatgtgttcgtttttaaataatcttcgggtaaggaatagagaaacaccaagcccaagaggcagaaggatctgtctatagctaatgagtgagaaactaactgtgggatggtttatggtctctggctctttgaaaccacagaaatttaaagttatttttaaaaagccaacttgactgggcacagtggctcatgcctgtaatcccgaggcaggcggggggccaaggcagacagatttcttgagcccaagagttcaagaacagcctgggcaatatggtgaaaccccatcttctcaaaaaaattaaaaaattaaaaaaaaattagccatatgtggtggtgcatgcctgtagtcccagctactctggaggctaaggtgggaggatcacttgagcctgagaggcgaaggttgcaatgacctgagatcatgccacactgcactacagtctgggaaacagagaccttgtctcaaaaaaaaataataactacacctaagcacttacaccattattttaagtcctgattactttaaggccataccacatgagtgctgaagatctgagtttaaaattggaaaaggtgttcctataattgcctggagaaaaaccaataattgcccagagaaaaaccacttgcagaagctatgaaaaaccaagttagattcctactagtcagccacgtcagtagctgatttcaaaatatgagttttgcagtaagccaggcaagacagtacaagtagcttctatttggggaatctaatctatataggttcttaatacatacttgcattgattgccattcaaatctaggagctattagtgcttcagctgtgggaaaattgtgagattatgcattgacagaattgagaagcaaattctacttcacgttgcagaaggctcatcagattttagattgatatagaaataatataacgaatatttctactacgctttttgtaaagtgaggagactgttctaaagtgactttgtatatgtaataactgaatccctttttaatgacaaaataattttaattgatatttatctagaaagttggttgttgatggttatttgacctatacaggttaacctcattttgaacatgttgactgaggacagtttcagtgattataagtcaaatcacatatctagagattttgtcaatgtattacagtagccatcttggttttgtggggcaatctaagccaaaaaataatgaagctgtttatataccttcctgctttttgctgagcatttttgataaatgtacataataccatacatgtagtatttgcatttaagcctattcagtgcatgcactgtctggaagagctctgactaaatagacacgtgcaaattttttccccattcagtgaacactattaaaaaatcagatgaatatttatacagtggcattggccatgcaattcttcctgctttgtccctttatcacacactaacagaacgtaggattaattatccacctaattaacttgggggtggggtagagttgctggataaagtacaagacactcagttcaattccaatttcagataaacatactaaaaatgtattcattgtttatctgaaattggaattgaactgggcatcctttatttttagttgctaaatctggcaaccctaggtggggaagaggcaggagactagtagatataggcacagttgtgagatttaaatacaccatgcaatgacaagagtaacctttactctcacgggaatactaagtgttttttagcgcaatgctatttattttagtgtccaatgcttttttctttttttttgaaaatgcatcaatgctcaaagctcaaaaatagtaaaacgtggctcacacttataatcccagcactttgggaggcagagaggcaggcagatcacctgaggtcaggagttcaagaccagtctggtcaacatggtgaaaccctgtctctactaaaaaaaaatacaaaagttagccgggcgtggtggcaggcacttgcaatcccagctacttcggaggctgaggcaggagaattgcttgaaccgggaggtggaggttgcagtgagccaagatcgtgccgttgtactccagcctgggagataagagtgaaactccgtctcaaaaaaaaaaaaaaaaagggagaaaaaagaaaaaaatagaaaaatgtaacaacatattgtttagggatacatgcacgtatgatgaactgtttttgaaaacaaaaaattaagggaacaataagcgaaatctgggatagtggttacctctaagggagcagcaagcagatggaataaagcacatagtagctgcactggtattaatgctaattctcagttaatgtggtaagtgacaggatgtatttttttatgcttcataattacgtgtacacattgcacatatcaaatacagaatagcattttaaaagataagttaaaacagacttcaataagaaaattagcctatgtgcaaaatttaactgtatatactttctaaaataaatccaaaatccaaaaagtaaggtcaaaaggcattctgaaattttaccagtttgctaaagatcatattgagtaattaatagattctagaatgattacttatctgctgtaatacatctaaaataattaaactctttggtttgtgaaaatttcatttttattacttgatgtctacagtggtgaatcttcagtttttgtctttacttggaaagattactgattgttcagatatattatatgccaaattaaaggaaagaaaaacagcaggtagagcatgcattaagtgattaattcaaatgagctaggcctaaactttaggattcctggaacaaaaaatcagaaatctctgttttccttgattaatttttaaaagttagatttctaactcctcgtttgtaaaaactattatgacagtctacaatatccatcagtaagcagaaaaattcatctttagcaagtgccagtttagagcattaagctgaagttagtgtttagtgtaaatttatttagtgttttaaagcacttctagctctctgtagtcttatataattttgtcttgtagaaatagctggagggtctattccagaaagcctatccaaatatgtcctcttctcccacttacatacacacttaggtgcccctcctctgtgcttcaaggttatcatgtgcttgtgtctctcattgcaattgttaccttatattgaaattatgtgttatattttcctcagcttatcagattgtgacctttctgtgggcaagggctggatctttctcaccctttgtatttcaatgcctgaaagtgcctggcacatggtagataaccaataaggatttgttgactgaatgaaggggcctaaagactcaactaatacagctccttcattttacaggtgtggaaactgaggtttaaagagattgtggctttagaaatagaaacaagaccacagagattgtctgttccagccttctacaatatccctattgagacatcattgagtttctgttttaatactttatcagggaagcagctcatggctttttctaaactcaggttgttactgagattgttaggttgaacaaaagcctatctctttgtaatttctactcttagtcctagttctgctgcataatgcttcaaacatttgaaaacaactacttttcttccttatcttcttctggttagccatccttagttctttatatcattccactcagtttctagaacattcaccaaattgatttctctcttctgagtatgttctgtttcatcagtgttccttttaaaatgaatctcaaaaagtatatgatgttcctaaatgtgcttttatcagtaagaagtagaagagaacttaccattccccttgctctggacatgatagttctgataattcagcctaaaaacacagtagttttggcagccatatcacagtctttgtctgagcaatcaaccaaaatacctaaatgttttcacatgatttgctgttaagccatgtctctcccatcgtgcattttacatttatccctactacatttcataccgttaagatttgacccattgttctagcccattgaaatattttggtggccagtggcagtggctcacacctgtaatcccagcactttgggaggctgaggcagaaagattgcttgagcctgggaggtcgaggctgcagtgaaccatgatcgtgccactgcactccagcctaagcagcagagcaagaccctgtctccaaaaaaaaaagaaaaaagaaaaaagaaaaattttggggtcctgtcagccagtatattacctgtctctctcaactttgtgttatctgcaaatttagtagatatgccatcagtatccttatccaagatattagtaagaacatcaggtagggtagaaagtaatttagtgcttaaaaccggatttttgtgtgtgtgcaatattctcttttattctaggccagtaaccctatcagaagaggaaattaggttaatcttgcatgattggcttctgtgaatgcttgctgactcttaatgagtatctttttcccttgcatagggctcttaaacaattaaacagtgtttaagaaatttgtttggaattgacatcaaatcaatctgtctgtagttggtggcatctaggcatctacctgctttgcagagttgactattagtgttttctttacatcatccccttccattcccctgattcttcaaaggttttagatggaaattgagctctgcaaattctcagatacactgggacataatttgggagagtagaatggaagtcacttataatattaatagttaggtacttttatctccttgaatgctttgggattcagtttcctcattctacaatttgtttttccctttctggtttgactatcagtaatcttaatagaaaaaaaagttgagatagccttttacattataataacgtatacttatccatatataagtagacctgcactttatatttgttgtgcttgttctgagtataaattaagaaaaatcttgtctccggtattttttttaaatcttagcacattctgagtgccagcctttctgataatgttcttacaggtttttgcaatttttcttggatatgtgcccattccatccctccaatctctcctgcatgtttttaaaaaaatatttcttctgacatgtcaccatgaagatgcaatcaacaaaattcagacatgagaaattctacaggatgagcaacctactttcttcaacacatgaattgcaagaaataagagagattgaaggggaacctgctgatttatcgaaagagacatatcaactgattgtaatatatggaccgtatttgattgatataaaccaaacgtacaaaaatttgggcagtctgggaagtctgaatgttatataacagcatgttatatataatatatataatctattaatgtatataataaggaattgttaaattttatagtagtgttgtggttatgttttaaagagaaatctttgtcctttttagatgcatactgaaatatttatggttaaaaatgaaatggtttcggccgggcgcagtggctcacgcctgtaatcccagcactttgggagaccgaggcgggcagatgacgaggtcaggagatggagaccacggtgaaaccccgtctctactaaaaatgcaaaaaaattagctgggcgcagtggcgggcgcccgtagtcccagctactcaggaggctgaggcaggagaatggcgtgaacctggaaggcggagcttgcggtaagccgagatcacgccactgcaccccagcctgggcaacagagcaagactccgtctcaaaaaaaaaaaaaaatgaaatggtttctgggatttgcttcaaaataatctggcagaggggtggaagaggagtactgatatttttatcattgttgaacatgatcaacatgttgtatatttgggtttataatattattctcccaattttgtatatatttgaaatagccataagtaaatgttggaaaaactccccctaaatatttattgtcacatagatttttactggcagatttgggactaaaactcaggtctcctgattctgctctttttttgtgtgtgtgtagctaaaattatagctcttgtactttcagattgatgtcatgttgtcctttcagtctctgggacccccaagctttccctgagaaatttgtggtagtacttgtagataaattaaggccttactaaagggtcacagtttcacttgactggctacctacctatgtgaaaccataagggacattagacttactagtgtagagaggctgcatgggttattagaaccagcaaagaaacttgggtcctagtcttcactaggccttagcataagttctaagatggcagggaccatgtctgttttgttcactactttatactcaatacctgggaccatgccaggtacatggaaacaatcagtaaatgttgaattaatggattaatttaaccgatggcataatttccctcacatgtaaaatgagacagttgatctaaatgattcttaagtttccttcaaacactgaaaaaaaaagtactcttgccttctgactgatttttttaaaatccttttaggattttgaaaaggattactgtaaatttctttaacactaggtgacatcagtaggtaatatgctcactttgaataactgttatagaaaaaccacagttgctatattgcatcaaaatctctttaaaaatagactactgttatatattttctgttagattggtatttatttctataaagtacatgcatactgttctcaacatactaaattagagagtcaggtttagcaagttccaaagtgtagccatctaagaaggttactaaaatgttccctttgcttgcatacttgtgctttttgcttcagttgtattgaatgcagtactattatgtcagagtttataaaggatttgacattttgcttcccaaggaaaaatcagtgggcaacttttggttaagtggcagttattgtcatcgcatcagtgactaggctcctatcattgggagtaatgaccttattatgaaattttgcttcaggtatctgtaggttatcgctgaatcaggtcagagtttgtaaaagaaaactaattcctataccgttttataaaatcaccagaacagtgttttgaagccacatacatgttttgaaatagtgactatatatatatatatatatatacttcttgaggacctttccgcattcctccagctccttctgaagccttgtcttggctgatacatggatgttgatgacctctcttgttgcttctcccagcagtgtttaccaagggcctttgggaaaggtttgcatgacatcacagggcagctagaggggagaagtgttgggagactggaaaggcctctgtgtgatgccactaatcatatgaagtagcaatccacatactcttccttttttttttttttttttttttggagacagaatcttgctctgtcacccaggctggagtgcagcggtggatctcggctcactgcaacctctgcctcccgggttcaagcgacactcctgcctcaccctcctgagtagctgggactacgggtgtgcaccaccacacctggctaattttttttttctttttgtatttttagtagagatgggatttcgccacattggccaggctggtctcaaactcctgacctcagacaatccacccaccttggcctcccaaagtgctgggattacaggcatgagccaccatgcctggccaaaaataatttctataattaaaatgctaaatgaatagggactggagaaagcatgtaataaactattttatattcagacatgagctttgttaatataaactaaatgttagctagtgtactagtgtatgaaaataactttcttttttattttattttattttttgagacagagtctcactctttcacccaggcgggagtgcagtggccctatctcggctcactgcaagctccgcctcccgggttcacgccattctcctgcctcagcctcccgactagctgggactataggcacccgccaccatgcccggctaattttttgtgtttttggtagagacggggtttcactgtgttagccagggtggtctcgatctcctgacctcgtgatccgcccgcctcggcctcccaaagtgctgggattacaggtgtgagccaccacgcccggcctttttttttttttttttgaaatggagtcttgctctgtcacccaggctggagtgcagtggcgggatctcggctcactgcaagctccgcctcccaggttcacgccattctcctgctcagcctcccgagtagctggggctacaggcgcccaccaccacgcctgactaattttttgtatttttagtagagatggggtttcaccgtgttagccaggatggtctcaatctcctgaccttgtgatctgcccgcctcggccaccaaagtgctgggattacaggtgtgggctaccacgtccagccgaaaataactttctaatagaaaacaggatataatgcattaaaatgttctatttatattgaaagttgctgaagtactaatcttaaaattgcctttatattcaaaacctaagtggaagacacactaaataattttagtatttgatctgtaagccatgtgggttttttagtagaatatcagtacttatttgaatcagaatttattttgaagctgtttcagacgttgctttttgtgtttaaattcattggcagcattgatagacactgtcttcaatttcagaaactatgctgcaaaatcaaaattttgctgtttttgacattagtctaggcaatgatattttggatttaaccccaaaagcacaggcaacaaaagcaaaaatacacaaatgagattgtgtcagactaaaattggtctgataaaattgcacagcaaaggaaacaacagtgaaaagacaacctacagattgggagaaaatatttgcaaaacatatggtttagatgttttgtgccctccaattcttatgttgaaatgtgaccttcagtattggaggtaggcctagtgggaggtgtttcagtcatggggcagatccctcatgaatgtcttggtgctgtcctcacgatgaatgacttcttggcctgagttcacgcaagatctggttgtttaaaagtgggtggcatctcctcccccactttcttcctgtcttgctatgtgatgcatcccttttgcattccatgattggaagcttcctgaggccctcaccgggagcagatgctggtaccattcttcttgtacagcctgcaaaaccatgagctaaaataataaacctcttttttttttttagacagagtctcgctctgtcgccaggctggagtgcagtggcgcaatgtcggctcactaaaacctccaatttcctggtttaaggaattctcctgccttagcctccctgagtagctgggattacaggcacgcagcagcacaccagctaatttttgtatttttagtagagatgagttttcaccatattggccaggatggtcttgatctcctgacctcgtgatccacccgccccatcctcccaaagtgctgggattacaggcatgagccaccgtgcccagcctaaacctctttttttttttttaataaattactcagccttaggtatttctttatagcaatgcaaatggactaacacaccatacatctgataagggattaatacccacagtatgtaaggaattcaaacaactcagtagccagaaaacaacccaatttaaaaatgggcagaggacctgaacagacatttctgaaaggaagacatacagacagatggccaacacacagtggaacactattgagccttaagaatggaatcatgtcatatgtggcaatatggataaacctagaagacattatgttaagtgaaataaaccaggcataggaagactactactgtataatctcacttgtatgtggaatgtaaaaatgatgaactcgtagaagcagagagtagaatggtagtttccgggggttgggggagtagggagcagctgaggaatgggaaaatattagtcagagggtacaaagttttagttaggaggaataagttctggagaactattgcacagcatgatgactataataataacaatgtatgtttcaaaattgctgagagagtaaattttgaatgttctcaccacaaaagatcagtatgtaaagtgaagaatatattaatttgcttgatttaaagatttaccatatttgtaattagtattaatatgttggaagtttgagttttgttttgtttctgctgttaggtgagcaaggaagcctagctcttgaaatttgtatttttgttcaactttgtaagaagcatatttattatttaaataaatatttattgatcagatagtaaatgcatcagaaatatttgatttaaaggtgccctatgatgaaagctttggaaagaaaaaatgaacttttgaagctctcattttggtttgtcgggttttctttaaaaacataccaccaatactcaaatatgtctacatgtaacttcagagttttctgaaaaattttccgtgtgtgtggtttaataaagttattttatgtagacatttgaactttttctgcaaaaaattaccttaatatgtaaaaaggataaatccaatttaccccatttagtatctatagaatattttgaagaaatatttttctatttttctttttttatttcttttttttttttttagctcctgctatcactggagaaaaaaatatttttctagttaactagatgtagcaaagtattattggacatttctgggtatgtacgtgtatgtctgattatatccgtgttttatataatatatttcaaatttaagggaaattagaggatataatatttagatcattaatcatggtacaaattatgtctccactctcaaactaatggtcttaagacaaaattccctaaaattataggaactctaaaatcccttgcttaagatatttctgctagttagtgggagagctaagagtagaacttaattttcttgacatctagttccccatttctccctcccatccccaaacttgaacatgaatagttgttttctttaggcacataaacactgaaatagtctactgttactatctctactttgacattagagacttatttacagagaatttttgagttgtctaaggatactgaagattaataacacctcacttatctgttggccacctctgtggtaatgacagttctcaagatacagctgaaaacaagaaataagcatttaaaaagcctctgaacagttcaataaaaaaaaaagtgccacaaagttcaaaataagattatgtacgtaaagtctcatggggagacccttaggatccctagattctcccttcaccatacaatttcatattaaggaaatctggtttcccagctcaatgcagattagaagcacaagtgagaaggatggtgggaagaaagcttttaaatgcaggcgcatggctgactgtaataagccaccgcttataggctgggtgcggtggctcacgcctgtaatcccagcactttgagaggctgaggagggcggatcgtctgaggtcaggaggttgagaccagcctggccaatgtggcgaaaccccatctctactaaaaatacaaaaataagccgggcttgggggcgggcacctgtaatcccagctacttgggaggctgagtcaggagaatagcttgaacctgggaggcgggggttgcagtgagccaagatcatgccactgcactccagcctggccaacaagagcaaaactccgtctcaaaaaataaaacaacaacaacaacaacaacaaaaagaagtgaccacttaaagtgaggaaggaaatataaaactataaaacacagacattccaggcatagtaacttagggtccttgaaggcaaataaatctgcactttagggtccctaaagtgtattaaaatataatgtagtatttgagcgtgataattaagaaggacaattgtatatcctttgtttaagaagatattttcagggaaagagtactgaaactgcaaggtttaacctactcatgtacttatttacaagctgcttttgagatttttaaattcaaaaatagttaaaatattatcaaaaatttggcactcaaaagcttcatctctctggaaattttacatgtggaacgtttcattatttcattccctagcagtccaaggcaattaggtgttaattgtagttgttaaaggcaggtcaggattcagagcctttgacttaatcagtttagtccaattcaagaagcagcgttaattgcctttactttggtgctcatacacagcaccagttacagtgttttcataattatcttcttttaagtccttacccagagaggaggcagtattgcgaagtggttgagagaatgggctctggagtcaggctgcctagggtcaaattctggccctactgtttactagctgtacaatgtaaatgacctaatctgactcaagccagttttttgttatgtaaaatagagcaagtaatataaccacctaataggagggctgtgaggaccaaagaagctaaaacatgtcaagtgttatagtttttggcaaatgcttaataaatgatggccattgttttattttattttattttattttattttttcattatactttaagttctgggatacaggtgcagaacgtgcaggtttgttacgtagatatacatgtgtcacagtggtttgctgcacccatcaatccgtcatctacattaggtatttctcctaatgctatccctcccctagccccccaccccctgacaggccctggtgtgtgttgttcccctccctgtgcccatatgttctcattgttcagctcccacttatgagtgagaatatgcggtgctttattatttttacaaggcccctattaggaaagttttgtgtgataatactaaataatgttttttattgcttcttagggtgaaatgaattggttttttttcatcttggcacatgatacaaatcattttagccaactttgcaagttataaatatgccttcactttttactaggcattaatgttctacaaatggatttagaaatttgtcacaaaggaattctactcttacagattaccctgttaaagacagttttaggcttaatagacttgaaattgtagtagtttgaaatgttcctacctaccaaggccttaacaactttgtaacatttaacatatacctcaaacatgagtgtcttttgttactagttttttatttagtgatgtcacccagttgcaagcaggatcccattttaatcaccagctcaatatgatatagctttttcatgttccctgtcgttaaatgtgctggaacttgacaggctataggggacctttgctgtattccagaaattggtctcaggctccccactactgacagactgccaaagtgcctttgagaaacttggagcatttcagagctgctgaagagactacactatcatgtgtgtcccatgtactcactcacttcatcctcatagaagttctatgaaatagatggttttacccccttttgcagaggatgagatcgaggcttggagaaatgatttgatcacacataggataaatagtagaaacaatattgaagcaaggttcatctgctcaaaagcctatattttactgtctcctcgtctctcaaaagaaaataataaattactctgtatagtttgtacacagttatatgtaaagccccaccagaaccaatctagaatatttccatatatttccatgtgtgtcagtaattagccaataactttgatcctatgaatcaacagccagagagtactgtttttgaaactagtggcacacaagaaataaatatggcttcctggtttttttttgtttgtttattttgttttttgacagctaaaaaacctgttcagatatctcaaggtgtgagggttgctggaaaggccaagtttcttcccttctctacctcatatggggcttaattttaaaatatcttacccttcttacctttatgcctttgttgcaggtgattggcatcctgaattttgtaccacatggaaatttgtgccccttaaaggtttttcaggctaggtgcagtagctcacccctgtaatcccagcactttgggaggctgaggtgggaggatcgcttgaagctaggagttcaagaccagcctgggcagtaaagtgagaccccatctcaaaaaaaaaaaaaaaaacaaacaggtttttcatttttgctttttaatatttgttgttgttttgattgcacttgtattatttaagatatcaatttgtgtggaatcttctttctttttttgagtatggattagcctcagtcctaactaatcaactctagataaacaggattttgatacattgcagtgtaagtttgtcaggggaccaaaataattagcaatatatgttttcatttctggaaattgtcctttgttaacacatatttatattgaccagacattgtaattaaatgggtactattttatgacaactactttttttgttttctaaacaaatttaactccctcccctaaactagaattttatctaatttatctttgtatctctagtcttggtacatagtaggtaattcataaatgtcagctttgggtgtctggttttattttttgttttgagacaaggtctcgctctgtcacccaggttagagtgcagtagcacaatcatggctcatggctcctgggctcaagtgatcttcctacatcagcctcctaagtagctaagactgcaggtgtgcaaccccatgcctggctggtttatttttattttgtagagatggggtgtcactatattgcctaggctggtctcaaactcctgagatcaagcaatcctcccgccttggcctcccaaagtgctgggattacaggtatgagccactgcacccagcccataaatgtttgttgagtaaagggattgattttctgttactcaaaagtaatttttttaacaaattaagtttttattagaggtcaaggattcctctaccaaaggaatcattacccagtttggcatataaaaacatgttagtaggactcatttcttctcttggttgtgctccaaaatacgactttgaggaaaagtcacttaatctcttggaatctcagtttcttgatctgtaaaaagaggctgtgtgattagatcatcttgaaggtgcctttcaattcaaatttgcatcatgtaatcattggattttaccaaaaaaaaattagaaatggcatattaattatttaaaactttcctattgcataaccccaaggtataactaagtagccttatgctttgaagcagatatcagactgttcctattcaaaaaaaaaatgtgggggaaagggtgaaatggtgaaaagttacttttaaaaattattacatccaggctgggtgcggtggctccctcctgtaatctcagcactttgggaagatgaggcgggtggattgcttgagcccaggagttcgagaccacctttagcaatatggcaaaccccgtctctatacaaaagtacagaaatcagctgagcatggtggcacgtgcctgtagtcccagtacttgggaggctgaggtgggaggattgcttgagcccaagaggttgaggctgcagtgagccatgatggtgtcactgcactcaagcctgagtaacggagtgagaccctatctcaaaaaaatatgtattacatccagagtagtctgtttaagaacagagtcttgctccagtagaaaaatgagctgagagtggtacacagtggttcgttcctgtaatctcagtactttgagagactgaaatgggaggattgcttgagcccaagagttcaagaccagcctgggcaacatagtgagaccctgtctctacaaaaaaatacaaaatattagctgggtgtggtggcgcatgcctgtagtcccagctactcagaagactgagactggaggatcgcttgagaccaggaggtcgaggctgcagtgagccaagatcacaccactgcactccagcctgggcaacagcaagactctgtctttaaaaaaaaaagaaaaagtaaaagctgagaacaaaaatgggtatctctcttcaaaatcgatataaatgtctaatacatatgaaaattttcatccacactggaaatcaaagtacaaattaaaacaccaatgagatatacttttgcctgtcaacttggtaaaaaaaagtttaaaataacacttatttttggtgagggtattaagaaacaggcattcacagagcagtaggagtgtaaacaggtacaagttggcagtttgaaagtagtgttatgtcatatacaactatatatgtacatatgaagataaaagatactcagatctctaggtgataagattatgtatgaatcactttaattttcttctctctcttttttttttttttttttttaagagatgggatcttgctgtctcccccaagctggagtgcagtggcacaatcatggctcactgcatccttgaattcctgggctaaagcaatccttgtgcctcagcctcctaggtagctgggtctacaggcaatagccaccacacctggataatttttaaattatttgtagagacagggtctcactccgttgaccagactggtcttctccactttttttttctttttctttttgagatggagtctcgctctgtcaccagggctggggtgcagtggcatgatctcggctcactgaaacctccgcctcccggttcaagtgattctcctgcctcagcctctcaagtagctgggattataggcacgcaccaccacaccctgctaatttttgtattttctgtggaggtggggtttcgccatattcaggctgatcttgaactcctgacctcaggtgatccgcctgcctcagcctcccaaagtgctgggattacaggcgtgagccactgcgcccagcctctcttccactttttgttttccacattttctacgtgcacacaagacttttcagtcacaaaatatatacacattttttaaatgtggacttgtctgtagtaagtgtatagaagtatttgtcttctcatctcctctattcaacacctccttacttttatttctgaacaggtctccaggaaaagttgggctttcaacattcaaggtaagttgtgctttctgaaagttatgtttttagaaattgtatactttttattcgtgtttttgtgtaattcttcattttcttgcttttgcttttttttacttactttttgctcagtaatgtagtcattatgtcctacttggtatacataggtactctagaaatacctaactaaatattatgctgtaaagaaggaactgtaagtattttttagatttctactgatttttatttgtttataatatctagaataaaagaacgtgtgtgtgtgtgtgtgtgtgtgtgttgaaaaagtgatacttggccaggcatggtggctcacacctgtaatctcaacacattggggggctgaggtgggcagatcagttgaggtcaggagtttgacaccagcctggccaacatggtgaaaccccgtctctactaaaaaaaaaaaaacacacaaaaattatccaggtgtggtggcgcagacctgtattcccagctacttgggagactgaggcaggagaattgcttgaacccaggaaatggaggctgcagtgaactgagatcgtgccactgcactccagcctgggtgacagagcgagactccacctcaaaaaaaaaagcaaaaaattaatacttgcatgacaaaaatgtacagtaactgaaacacatgtatacttcttgtgggcccatgtaccatcactatatataaaaatcaatcccagcttatattcaggcagaggagtttggtattgagatattatgccactgagagccattttaagtataagatatcaccaaatggaactatttatatcagatagagtatatattgtatatgtatatttatatgtatgtgtaatctcaaacatgctatatttttttcagttccagtataccgaccttctgtttatacacattggataccagtctctttgataaattatgatatgtttatatgaaatattctacagtagtagaaatgaatgaattagttatatacaatgacatggatgaatttcagcactagagtgttgagttgggggtaactactcatagaaaaacatatacagtaacgtttcatttatattaagttcaaaagcatgccaaactaaagaatatattgtttagagaatagattgtttagagatacaagcgtggtaaaactgtgaagaattaccagggaatgagaaatacaaaatttaggatatcggtcattctctgagggggagagattgtaatggaaatggagaaggatacacaagagacttgaaaactgataataatgttctttttcttaaattgagtgcttaagaaaagttatatcataactcttacgctaaataaaaattattttgtatttacttaatatttaataaaaacagtctttaaaagtaataacgtgtagggttgaaatttactcaggacaaaaggtatatggttgaaaatgtagctttccttccacttctcatcccccacctctcaaacttcatatccagaggcgattactgtttatgcttataggtcttaaaagccatttagcgctaagatatttttatattataacaaatagatttggagaatttactttaccccgtaattatagattgtccttaacttgagtgaaattagataacaagtatacatatttagtaaataaatatgaagttggatattgttcatttttttaactttttattttgaaataattatagattcacaggaagctttaaagataatgcagaaaggtcctgtatattcttcaccatttccccagtggttatatcttaattatagtacaattttaaaatgaggaatttaacgttggtgcaatgcgagtgtatagttctgcgccaatttatcatgtgtatatttgtataaccaccacaatgaagatgcagaactatttcatcatcacaaagatctccgttgtgctacccctttataatcacacccaccaccttccccatatcatccctaaatctgttttccatctctataattttgtcacttaaggaatgttctataaatggaattatatactatgtgaccttatgggattggttgaaagggtcacgatccatccaagttgttgtctgtatcaatggtttgtttctttttattgctgagtagtattatatgataaacatgtactgaggctattgagtgcatattatgaataacagtatatctattgatattgtaatataaaggaaggcttgatatagttctgattgttggtgattttacagtctgatggaagagacatgtatacaaaagggcaatttatgaggtctcgatgtttgtaaaatagaatagacgtgttaactgccacaaggggtttggaggaacgagaggaagatagaattggcgtgagagcactgttacctgaaatagcagagaaaagtttcagggaggaaatagaacttttgctgagctttgaaaattgggagaggtttgcataggtagatagagaaaaattgggaaagcattgtagttaggaaatagtagggactaataaatatgcaaaagcatgggatttgctagaagcattgaaaaactgtgaccagtgtaaaagtttcagtggtagagtactggaaaataaattgaggccagattgtgatgagccttgaatgtcaggttacctgattttatcataatactatgtatacatgcattgaaacatcacattataccctgtaaatatgtatcatattatgtgtcaattaaaaattaaattataatttagaaaagagatggggcgcagtggctcacgcttgtaatcccagcactttgggaggctgagacgggcagatcacctgaggtcaggagttagagaccagcctggccaacatggtgaaactccatctttactgaaaatacaaaaattagccaggcgtggtggcacatgcctgtaatcccagctacttgggaggctgaggcaggagaatcacttgaatctgagaggctgaggttgcagtgagtcaagattgtgccactgtactccaccctggacgatagagtgagactctgtctcaagttaaaaaaaaatttagaaaagaactctgatctttaaaattttgaagcaggatatttttgggtttcttttccttgcttttcttttcttttctttcgttctttcttcttttttttttttttttgatggagtctcactctgtcacccaggctggagtgcagtgatgcaatcttggctcactgcaacctccgcctcctgggttcaagcaattttcctgcctcagcctcccaagtagctaggattataggcgcccgccaccacacccagctaatttttgtatttttagtagagatggggtttcaccatgttggccacactggtctcaaatgacctcaagtgatctgcccacctcaacatcccaaagtgctgggattataggcatgagccactgggcccgaccagtatatttttgttttttgaaggtctcactctgtcacccaggcaagaatgcaatggcacaatcacagctcactataacctcgaactcctggtctcaaggactcctcccacctgagactcccaagtagctaggactacagactcaaaccccacacccagctattttattttatttttattttttagagatagggtcttgctaggttgtccagactggtctgaaactcctggcctcaaaccatcctcctcccttggcctcccaaagcattgggattacatgaatgagtctctgtgccaggcctaaagtgggacatttaaaaagtcaacttttatatgtcttacagctgtgctgccaaggtggtttttttgtttgtttgtttgtttgtttttgctcgggaactaagaaaactggtggaagggtggaagaaagtttggaggaaaaagacttaggtgcaaagaaagctgtcaagaggcagttaaaatgtcaagacatgagactccaacaaagggaacagcattgaaaggagtggatgtatggatatgacagcgatttaagagttgtttactttttagaacaattttctcagcaaaaaaagagtggaagtcacatttataagtttttctccttttttaaaaaatttcactttagtagcttcccttcccttactactaaaaattaccagttacctgaatttttctataattaatgtttttagcttaatgttctttagtaggtaataatgaagatttctgtgagtgtagatcactttcatacaaatactttgttgggtgtacttattaaaattaaaaagctgaaatcttataaccaaatactgcaggggggttatagacagctctgtaatatccaacacaggtggaggtaactgttacatgaattgctgaaaattgaataagctaccataccttttaaggaagcaaatttttgataccatgatagataggagttagagaaattgcctaatagtagggaagctgggatttagtaagtactgcattttaataatgggtcagcacatcaccagaagtaggtaatggactgtctcaagtatagctaagttggcattggttgtctgtggacacatgcttggcttccattcctttgtcccaaaagcctgatcaaggtgttagaaggacctggatgttatacatcactgagagagaatcataattgactatatatcctaagtctgattttattaagaagtcttctctggagatcaggccctctggtaggtgccatatcactcctttaaacttgtgacttaaaacagcagagtaccttaggagttactatcttttaaaagttcagactccaagagagttttgttaaagccaaataaaatagaagtctgatcactgcttggcagttttggctagtgtaggaatgttaatcttttataagtaaataattgaaacaaattaggccgagtgcagtgacacataggccaagtgcagtgactcacgcctgttatcccaacactttgggatgctaaggtgggaggatggctgcattccagcctgggcaactgcgagaccctgcttctaaaaatcagttaatcaaaatgaggtccaaagattattaatgtgtaattttatgtagcttaatttagggaaaatatccacagaattatgctgtacaatgcttctgattttcctactgataaacagttattagaaaataattggataaaaataattagtaggacagttgaaggtgtttctctaatatgcattaactgttatttatttatttatttttttcttttttcctgcggaccccgttctgctgagagcatcaactattcttaatggtgatcagcttccaagtattctttttttttttttttttggagacagagtctcgctctgtcccaggctggaccaagtattctcttaatggtgatcagcttccaagtattctctctccaccttgtcaaggttatcttatcaattggtcttggttagatttttatttcttttttttaatttctttttttttttttttttttgagacagggtcttgctttcttccccaggctggaatgcagtggcattatcatagctcactgcagcctcaggctcctaggctcaagtagtcctcccacaacaacctccaaagtagctgggactgcaggcacataccaccatgcttggctaattattattttttttagaggcgaggtctcactgtgttgcccaggctggtctcaaactccgggtttcagcctgtgcccggccttctttcatataaaaccaggatccaattaaagcctatgtaaacttaagatgtatgtattaactgaagaaaaaacagagcatgcatcattcaacattcattcagcaaatgattatttagtgctggacactgttttaggtactgaacaaactgtagatagaacaaacaaggtccatctctcatggagcttacattctagtgggacagggaagagacaaaaaataagcaagtaaataaggtcatttcgaacgataagtgcaatgaaggaaaataggataatgttttcccagcaccatttattgagtagggaagcctttccccattctttgttttcatcaggtttgtcgaagatcagatagttgtaggtgtgcggtcttatttctgtattctctattctgttctattggtctgtgtgtctctttttgtaccagtaccatgctgtttggtaactgtagcactgtagcatagtttgaagtcgggtagcatgatgcctccagctttgttctttttgcttaggatttgccttggctattcaggctcttttttggttccctatgaattttaaaataaaatttcctagttctgtgaagaatctcagtggtagtttaatagtaatggcattaagtctatacattgccttgggcagtgtggccattttaacgatattgattcttcctatccatgagcttggaatgtttttccatttgtttgtgtcatctctggtttctttgagcagtggtttgtagttctcctttcacctccctagttagctgtattcataggtattttcttttcgtggcaattgcaaatgatgggagtttattcctgatttggctctctgcttggctgttattagtgtataataatgctagtgatttttgcacatttattttgtatcctgagactttgttgaagttgtttatcagcttaagaatcttttgggctgagactatgggttatctagatataagatcatgttgtctgcaaacagggatagtttgacatcctctcctcaatcccattactgggtatatacccaaaggaatataaatcattctattataaagacacatgcacacacatgttcattgcagcactattcacaatagcaaagacatgaaatcaacctaaatgcccatcaatgatagactggataaagaaaatgtagtacatatacaccatggaatactatgcagccataaaaaagaacgagatcatgtcctttgcagggccatggatggagctggaggccattatccttagcaaatcaatgcaggaacagaaaaccaaatactgcatgttctcacttataggtgggagctaaatgatgtggacacatgaacccatagaggggaacaacacatgttgaggcctatcagagggtgaagggtgggaggagggagaggatcaggaaaaatgactaatgtgtactaggcttaatacctgggtgatgaaataatctgtgcaacaaaaccccatgacacaagtttacctgtgtaacaaatctgcacatgtacccctgaacttaaagttaaaaaaaaaaagaaaaataggataatgtgatagaaagttaaggagtcagctaaggctattttgagatggtcagggaagtattttctgataaaatagcacttgagctatgaccctaatggcaaggaatcatcctattggccagaatgtaattgtgggggagtgatatgagagggagatgaggagtgtagaagatatcaaaaatgtaggcagaggctatgtcatgtttaggccttcatgggccttggtactgtttggattttatctaatacttaagagtccatgaaacatttttttttttctagaagaatctgtgtaagattggtagtattctccaaattctgggggaggaattcagtgctcgaagatattgcaagtcctacagaaatttcactggcacgttaaatctttaacattttaataatctctggagtaatttcattattgagcctattgtgatcatatcctgatacttgtataagtgccacctaaataattaatgtgccttgagtcctttatctgtctaaaatggttataatgaccttcctctaacaaactctgtgatgtgcacaaagaattatggttttttttcctcagtatcaagagtagcattcaaattgctgtgcttctataaatagacaacttaagattgagaagagtattgtattgagatttgcaaatatatgattgtcttattttaccctaattttttccagcagaaatgcagtatccatttctaacctcccaaatatatatatatatgtacgtatgtgtatataaatgtatacgtagatatatatgtatttttggtgggtttaatttttttcatcttttttcatagtttttttaggggcttcatttaacttctggttaagtcttgatttcttttatctaaagcatgtagaattttaagaaaactattccctgaatgtggttttctgtgttataaacttttgtatttgtgcatatttatggagcaatgctttggggaaaataacaatttttattcagccccttgcttaaatccttaatcctttttagctataaaagtacgtagaagttcttatcgtccattacagttttttaatgttaaaaagttgagcaagttttcacatttaaaggtaaatatcctattgcagaataatagaatattgctgatgggtaactttcttatgcaaattacattgtcccatttggcataaaatttctgagcatctatcagtattcagaaatctaagccctttaggctgggcacagtggctcacacctataatcccagcactttgggaggctgaggtgggtagatcacttgaggtcaggagttcaagaccagcctggccaacaaggtgaaactctgtctgtactaaaattacaaaaattagccaggtgtggtggcacgcgcctataatcccagctactcgggaggctgaggcaggagaatcacttgaacccgggaagcagaggttgcagtgagccaggattgtgccactgcactccagcctgggtgacagagtaaaactctgtctcaaaaaaaaaaaaaaaaaaaaaagaagaagaagaaatcaaagccctttaagggcctttgatttattaatgctacattttctcatttgtacccctttaaagcatatttttaaagaaaagatgtcatcatttggtctctatttcttttctttttcaaacaggaaacagagaacactgcatacaaagttggaaatgagtcccctgtacaagaattgaaacaagatgtgtctaaaaaggttggaaagatacaatgtcaatattagtttatagcagacatcatatttatatggtatatttcaaacagcttttatattcttttagtatagcgctctgtacatggctgatgttcagcaaatgtttcatgaatctgtcacatttgtggttgaagacatttcagtctttttagaagtccttttcatattctaattggtaatttatccttgagacaatattttgtaaaatgcttttattttttgttcttgtatttttatcagaataagccctaactcttcttgaggttactaccaggagttatgggtattgaaaagctcagtgcagcaacattctgatgtctttaggaatcagaagttataagaagtccttactctgatagtacctgataccttttaaaaaattgatgctatgaagcttcaaaggttggtttactagaagagactgagcacaagatcagtattttgaaaatgggcagtttacagtatcaggataaaactcaaggagaaagacaggatggtgtgtttttattcatttatacaagttttaagtgttttctgtgccctaggcaatgttctagccagtgggtttccagaggctaacaaaatgacacattctccaccccagagtttctccagtactggcactcgacattttgggctaatagagggtaggggaaggcctgttgtgtgcattgtaagatgttttagcagtatccccagcttctacttactaaatgccaatagcatcctcaactcccaattatgacaaccaaatatatctccagatgtctgggaaggggtatggaacaaaataacccctaatggaaaaccactgttctatccttatggaatttagaaatttaatggactacattttttttttatttgaggcagggtctcactctgtcgcccaagctagagtgcagtggcacaatcatggctcactgtagcctccacctcctggactcaagtgatcctcccacctcaccctcctgagtagctgggactacaggtgtatgccaccatgcctggataatttttgtatattttatagagacaaggttttgccatgtttcccaggctggtcttgaaattctgagctcaggcaatccacccacctcagcctcccgaagtgctgggattataggtgtgcaacactgtgcccagcgagaccacatattttgatattgatcatactttttcctttaaaggaaaaatgttcccttttgggacgaatggtggattgcatagcagtgtacataacaggaattgaaccatttttttaaaaaaataagaaattgcctataattctatactataacacacaggtgtcttgatttttcagcatttccttctggtcctcatccattagcatacatttttctgcctaattgtagtgtaggtagaattttatattctgtcttttactcttaccatttttagattttcctcatacttctatatgagttctgtactcagatgcatcagattccatcaagtaaatggattacaatgttatctagccatttttattgttgaaacttaaaatattcctgttttttccactatagcttttcttattttttaaagaatgtttttcttaggataaataacaaatgtataactatctatagttagtggggaaaaaagatgattttaaggagagtttagaagtttaaacagtagtgagaaaacactgtggagcagaatgaggtttaagattctaaataatcactttttaagttctagccttttcagttgaattaagtatgaatcactaatgataaaggctatggggatataccctggacgagggcatactctgctctcgagtaacttacattttagtagaagaaattggataaacacaaaactaaatgcagtaagtattcaaataaacttagaagctattgtaagaacacaaagggaaggagacttcttgcttgggggtaggaatgaagatgacttcatggaggaggtagcatctgagctggttcttaatgaatgcataagatttggacaggctaggccgggcacggtggctcacgcctataatcccagcactttgggaggccgaggcaggcggatcacctgaggtcgggagttcgagaccagcctgaccaacatggagaaaccccatctctactaaaaatacaaaaattagctgggcgtggtggcgtgtccctgtagtcccagctacttgggaggccaaggcaggagaatcgcttgaacctggaggcagaggttgcagtgagctgaaattgcgccactgcactccagcctggtgacagagctagactccctctcaaaaaaaaaaaaaaaaaaaaggatttggccaggctaagatgggagaggaaaggcattactgaaggcatggaggtggggaatgtgcagaacatttgaggatgagcctagagagcaaagttagggctggattataggaatgccttatgtcatactaaactgtctgctttttatttatttatttatttattttttgagacttgagtctcgctctgttgcccaggctagagtgcagtggtgtgatctcagctcactgcaacctccacctcctgggttgaagcaattcttctgcctcagcctcccaagtagctgggtttacaccaacacaccaccacgccaggctaattttttatatttatttatttatttatttattttgtatttttagtagagatggggtttcaccatgttggccaggctggttttgaactcctgacctcagttgatccgcccacctcagcctcccaaagtgctgggattacaagcataagtcaccgtgtccggtcacagtgagctttttgcagcaaacaatgctttagcataatcatctctatgtgtgtcttggttctcattgttctcttagtctttccgttttcactatttcctaaaatccagaaaaaaatgacagggctaggcaccataagaaggtgtcatgaggcatatcaagaggcaaaaaacatggacctttctctccaggtactaattatctggtgtagagaaaataaatagagctagcctatatacagctctgtatttgtattatagttcatactatactgaacagtaagaataataatagaagtgcagaggagggagagattattatcagataagggattggggaagatgcattttcaacctcattttgacccctcttgtggcacagacatttccattatgtgtagtgattatttcaaacctttatactcacctcatgctcactgtacccactcacatccccctcactttcagccgataaccttgtttcctactccacgtaaatattagaggctaaaaagcctgaatccattcctttgtatcatctttcacttcctttacctacatatttattgttatttcttacctttttttcatgtcatccatcactgaagatttagtattcttgttttctgtccaaagtagtgtggtataatacaaagatcactggatttttaagtaagacctggatttcagttttggctttgtagcttactaattgtgggactggcaaaattcttaaagcctttacctcagagtcctgcttttctaggagggaggtaatccagctacctaacccaaaggcctgtatgacaattaaatgagaatgtgtatactaggtctaatacacagtaggccttctttcctttcttttccagaacattgctctgttatcttcttttccagtagttccttcccttcaggttataaaagtgctgggtcactttatcgaagtctttttgcatttatagctaagctttttgaaaactcagaccgtgctaatgtctctgtatcttcacctcttattcaatctcaaatccattgtaatatgacttctgttatcactgttatcattgaggttctcagtgctcagtaaccacctaattgacaaattggttggactctggttagttttggtgaaagcaaggtaatttctaaggttaacaatttgaagtttgagaaaaactaacatatagaacatgctaagaaatcagggatgaatattactgagcagcagtaatacccagttcaagttagcatgaaattgtagtaaaccagattaggatggttctatgatgcattctgttaactttctgaagccagggaattgagaaagcagaagttgttcatggttggacatggtggcaggataagtgatctgggagatttaatattagtaatgacaagactggggagaaaatatattctaaatgttggcagaagataatagaaagcctgtttatattttaagctacatataagaaagggggccaggcgcagtggctcatgcctgtaatcccagcactttgggaggctgaggcaggtggatcacatgaggtcgggagttaaaggccagcctggccaacatggtgaaacctcgtctctactaaaaatacaaaaattatcccggcgtggagcacctgtaatctcagcttttagggaggctgaggcaggagaattgcttgaacctgggaggcagaggttgcagtgagccaagatcgtgccactgcactccagcctgggtgacagagtgagactccatttcaaaaaagaaaaagaaaggaagggaaaagacaaggtggactgggtatttgaactcttttcatggtcctgccatcagtccacatagtggagtttaggtgtagtctgtttaagaatgttaatctccctgcatctgctggtttttgggtcataagcttgagttcagagctaaacaacttgaattcttctcctggggatttggattatcgtggtttggttaagtaggctcaaaccattaggctggtattacaacaagtttggcataaatatgtaaatgaatcaggatattgagtcttaatgtaagtttaggattgaacttgattttacaggattatttgatcttttgtacctaagtattaacacaaatttgctattatgagggttaagagtatagatgctggaatcaaactccctgggtttatacctgcttcatcacttactagctttgtgaccttggacaaatcatttgattagttccctaatttgtaaaatggtgacagtaggagtagaatctcataaggttgttgtaaagattaaaatatgtaaagtgttaagaacattgcctggcacatactaagtactatgtaaatgattagctgttactgtgttcttataaatagcttcatttttaaaaactacttttaaccctttcatcagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatggcaagtattaattgagaaatcactctgttggttgggcacagtggctcacgcctgtaatcccagcactttgggaggccaaggcgggcggatcgcttgagctcagttcaagaccagcctgggcaacatggcaaaaccccatctgagcaacaacaacaaaaaaaaatacaaaagttagctggccatggtggcacgcgcctgtagtcccagctacttgggaggctgaggcaggagagttgcttgggcctgggaggcagagactgcagtgagccaaggtcgcgccattgcactccagcctgggtgatcagagtgaaatcttgtctcaaaaaaaaaaaaaaagagagaaataactctttgtggtgaaattttggagttgaaactgtttacctttctgcctttatttcactttattaaaaaactcactggcaaccaagttattaaaattatttctttagtaatagacaaaatgtaaaaatgtttacattggtgaaaattactttactgtaattgaacacttcagcagacttcaaactttcaattctgttgccatctgagagagagtggcatggtgaaaaaaacttgggatttggagacctaaagtctgaattcaagtcctgcatcttttttttgtatgagctgtatagtcttgaggaaattaaataacttgtttgaaccatggtttccctgtataggaaatgagagtaatcaagccactttcctcacagggttgttacaagaatcaaacaaaaagggttgttattattgttgttattattatcattgcagttcccaaagagaatattacgtctgattctctcctaaccgcaagcatggcttcagaaagtacggttaaggattctcagccttctcttgatttggcaagtgctaccagtggagataaaatagttaccgcccaggttggtgaattagtgttctgtttcatatagactttatcagctccctgcaactggctggtttgttgatgattattctgtattctccaggccagatttttctttgtcctccaaacctgacccccttacttctcttgatcagctctgctacatgctaactgggtgagcctagcaagctgtttagcatctggatctcagatgccccatcaataaaatggaggaaaagtccttccttgagggtttgaaatgagctaaaatatgccaagtatctagcaggtaataggtattcaaaaaacgacagatgctactatttgtaatattgttggtactaataaacaccaactatagtctatgtttgtcctgtattggtcagaattgaagactttttttttttataatttccttttcctaatcatagaaaaactttatatgctaggaagcgggctacacaaaagacttgataacactaattttaccacagccagattctgggactcagagctacttacatggtagctgtggtgggccaggctaccacactagaatataggacactatagtcttgttatagccttagagcaggggtcagtagtggcctgctttaggaggttccccaagctaagaatgttctttacatttttaaaggttgtttaaaataagaagaagaatatgtgacagagactctatatgaacaaaaatgccttaaatatttactgtatggctctttatagagagaagttttctgacccctacctttgaggtagccacatacagtccagattaatagcagtcttagtagagaaatgccttttggccaggttcaaatagaacatttatttgttttcaagaatactaagacattatttcatgagcagcaatagttttggttcctaatgtttttcagcatgctgggaaaaatgaaggactgaaacgtaatgttccatttagattttcagcagactccattatctgaattatgaaattctttagaattatatgtggtaataattgaaaatttatagaaattgattcagtctaatttctgtttataaaattatatttccaggaaaatggaaaagcacctgatgggcagactgtagcaggtgaagtgatgggccctcagagacctagatccaactctgggagagagcttactgatgaggtagaaatagatttttttgttcttgttcttaaaacataaagtacaaaaaacataatgggaagatgaaaacgttctggagatggatggtaatgatggttgcatgacaatgtgaatgtacttaatgacccagaactatacacttaaaaatggttaaaatggtaaattttatgttatgtgtagtttaccacaatttaattttttttaagtttattgctgttacacacaaaaaaaaatacagaagaaaaaatgaaaattgaagattgtctttgttgatatgctggatgtagcatctctgacttaaacttgccctttcactgtgttgcatagtggaataaatatattgaaagcaaggtttatattttatagaaagtgggctttaaaagaacttgatattgaggccaggtgtggtggctcactcctgtaatcccagcactttgggaggccaaggtgggcaggtcacttgaggtcaggagtttgagaccagcctggccaacatggcaaaaccctgtctctactaaaaatacaaaaattagccaggcatggtggtgtgcatctgtaatcccagttacccagaggctgaggcaggagaatcacttgaacctgggaggcggaggttgcagtgagccgagatcacaccactgcactccaacctgggcgacagagcaagactcggtctcaagaaaaaaaatttaaaataatataataataaaagaacttgatattatgaatatatgttataccaaaataaatttttttattattttaatggtttcttatcattaaaacttagtatgcacctattagccaacttattcagaattaaattttacagcaaaatcttagttgatgtttctttaaaacaatacatttcttaaaatattgcactttggaaaacagtttggcaattcctcaaaatgtgaaacatagtgttaccatgacccagcaattccgttcctttgtatataccaatgagaaatgaaaacatatgttcacacaaaaaaatgtacacaaatattcacagcatcatcattcataacagccagaaagtggaaacaacccaaatgttcatcactgattggatggataaataaaatgtggtatattcataccatgttatattttttagcaattaaaaggaatgaagggataaagtactgatacatgctacaacatggataaaccttgaaaacatcatgttaagttaaagaaaccgacataaaacgccatatattacaggatttgatttatatgaaatgtatggaataggcaaatctatagagacagaaagtagattggtatttgccaggggctaaaaagaaagggaaatgaggtgtgactgctaatgggtagggaatttccttttggggtgcagaaaatattctgacttagtggcaatagttgtacaactctgtgaatatactaaaaaccattgaattatatgctttaaatgagtgcattttgtggcatgtgaattatatctcaataaaaatgttagaaattattgtgtgcagtattgaatatatctaaaaagcctttagcttaaattttaggggattttgtagactcaaaaagataattaaattgcaggtcatcttggtgtgattgttttttttttttaacctcaggaaattttagccagtgtaatgattaagaacctggatactggagaagaaatacctttgagtcttgcagaagagaaactaccaacaggcattaatcctctcactctacacatcatgagaaggacaaaagaatatgtaaggtatggcctaatgttgttatttgtcatttctagtatttcagagttgttaagatttctctgttaatgaactatgacaacccctaatttggtttcattcagtcttttttcttctggaattaaaatagagttagataatgtatgtattctttaactttgctcttcattatgactgtacagttacttggggaaaatagtataaatattaaatcccatagcacttaatttctcttttttaatgatttaaattatacttgagacaatataaaaacagtgaggcagccaggcgtgatagttcatgcctgtaatcccagcactttaggaggctgaggcagcacttgaattcaggagttagagaggagcctgggcaacatagtgagacctcatctccacaaaaataaataaataaattaaaataacagaaaaatgaggctaaaaagctatgtagaatgaacacttagtcttctgaaaccttgctttaaggatcataaattgtttaaatatttgtactgtttttgtaggatcagaaaatggctttaaaatgagatgagtgactttactacgagatgtatgtggatctattgaatcattttggtaaaagcaggagctattttattaaatgtaatgcaggatgtacttaatgagtggggaggaagatacctacaagttactttattatttccctatagcacattttgccaagcaaaaaggtttgtttgtagtaggtttttcataaatttctaaattgcattcatttacatgttgtacattgaaccttgcttaaagattcttttcttcaatttctgaagcctttaagttgtcaggtccatcatttaaattaaaattatatgggccgagcacagtggctcacacccgtaattctagcactttaggaggccaaggtgggtggattgcctgagctcaggagttcgacacgagcctgggcaacatggtgaaaccctgtctctactaaaatacaaaaaattagccagacatggtggtgtgcgcctatagtcccaagtactcaggaggctgaggcaggagaattgcttgaaccagggaggcggaggttgcagtgagccaagattgtgccactgcactgcagcttgggcgacagagcaagactccatctcctaaataaataaataaataattaaaattatgtaaagcttattagcgtagtttttcttattctgattaactggttatatagtaagtataaacagatttttaagaagtatagaagaaatggcttcttttaaaacaacttccccttcttacagtaatgacgcggcacagtcagatgatgaagagaagttacagtctcagccaacagatactgatggtggaaggttaaaacagaaaacgtgagttacagtacatcccttttcttcatttcaagtttttatttaaaaaaatatgagaactaccatactattttaaatcatgctccatgtagtttttatgtctacccaccaccattcctccctgtccctcgctgatgggttatgaagttgtattgattagttttaaagcatctgggctgggcgcaatggctcacgcctataatcccatcactttgggaggccaaggcaggcagatctcctgagatcaggggttcaagaccagcctggccaacatggtgaaaccccatctctactaaaaatacaaaaattagttgggcatgatgacaggtgcctgtaatcccagctacttgggaggctgaggcaggagaatcacttgaacccaggaggtggactccactgcactccagcctgggcgacagagcaagactccccctcaaaaaaaaaatggtaataataataaagcatctgacatacagaaaatgaccagtaagtgttgcaccatacttgtgttatttttctaccagtaggtaggtacgaaaagtgttagtagaagaacatgattgtccttgaagttgtcttttccctttctctttatctctgcaatcctatttgtctttctaaacccaactataatgagattcctcctgactactacagtccatggcaattttctttcttttctcaattttgggaatacctgtagtctataacttactttttccctttacaatatgttatcttaaactgttttcagacaaatacacattaaacaatcaaagcgtatgttgcaaaaggattctgattatgccatcctttgtttcccctacaaacttctagatcaatggtgggcctgtacattttgtttgattatacacaagtcactaaattgataataattaactctaaggtccaaagtgaattatccacttgagtccttttcctagtgtgtatcaaagaaagcattgagaatttttaggaaagatgtacctaaaatgcaggcatatgatagcaccttagatatttggaacttggccatctagtagttgcagttattgggaacctgagaataaggaattactacaattattctgggacagataaacatccagaagagatgtcacatagtccatgcactaaagctcattatttttctaagagaaaagttcctcaggtttattcaaagccattatgcttatttcttacatcattttttttaaaactctgttcagtgtctgagcttactgcaaaatagaagcagcaaactgtgacaacatgtaagttgacacataagaatgtcaggtaatcagaaaaatgataaaataactcataatataggtgggtgcagtggctcacacctgtaatcctagcattttgggagaccaaagtaggaggatcacttgagcccaggagtttgagagcagcctgagcaacacaggtagactcactctttaccaaaaaattttaaaaattagccaggcatggtggcacacacatgtggtctcagctactcaggaggctgacatgggagaattgcttgagcctgagggatcgaggctgcagtgagccgtgatcacaccactgcacttcggcctgggtgacagagcaagaccttgtcccccacaccccccaccaaaaaaaaaaaactcatagcacaatcattgtaccacagtgcttttcaaccttttcttatgccattgacacacagagaacataatagtatttgcactgaatgttggggtaagctggccatcagctgatggccagagaagattggcccaggcttccctgggccctgccctgttgccttgaaggctgagtggggaaccaatagtatggcccacctgcaatgcattagaaaggctctgaatgtattaaagaaccaaaatgatggtaacgatcttatccatcaaggaatgaaatttagggaacattaagtgccatttaagaaggcataaaagtagatactttagaactattaccatctgaaataattaaaatgtctgttttcttggcttttaaagtggtagtaaacttataattatccagaaaatacagcttcagagttataggtagcagagaccttataatggctttaaaaatggtttatcatctgtgttttctggttatcaaaagaaatacagaaatatgtaaaatagaaaatgaaagtttctcataatctcagccccagaaatcagttttgtttttttttttattatactttaagttttagggtacatgtgcacattgtgcaggttagttacacatgtatacatgtgccatgctggtgcgctgcacccactaactcgtcatctagcattaggtatatctcccaatgctatccctccccactccccccaccccaccacagtccccagagtgtgatattccccttcctgagtccatgtgatctcattgttcaattcccacctatgagtgagaatatgtggtgtttggttttttgttcttgcgatagtttactgagaatgatgatttccaatttcatccatgtccctacaaaggacatgaactcatcattttgtatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggctagtgatgatgagcattttttcatgtgttttttggctgcataaatgtcttcttttgagaagtgtctgttcatgtccttcgcccactttttgatggggttgtttgtttttttcttgtaaatttgtttgagtccattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataagatgtaaggaagggatccagtttcagctttctacatatggctagccaatccagaaatcagttttaatagcatggtgtattcgccatagaatttttttttctcgtaaaagcggggctactctatgtctatagtttgtcaacttgctgttttttgttttttttgtttttttggtttttttttagaaaatcaaatatatcatagacatctctttatatcagcactaataatatatatattgtagtctttctgagagccagatatgagagttaagtgcttgggatataacagttaagacattaagaggccaggcgtggtggctcatgcctgtaatccagcactttgggaggccgaggcaggtggattacctgaggtcaggagttcacgaccagcccggccaacatggtgaaagcccatctctactaaaaatacaaaaaattagctgggcatggtggtgggcgcctgtactcctagctactcgggaggctgaagcaggagaattgcttgaacccaggaggcagagattgcagtgagctgagatcatgcctttgcactccagcctgggcatcaagagtgaaactctgtctcaaaaaaaaaaaaaaaaaaaaaaaacattcaggatgggtgcaatggctcatgcttgtaatccgagcactttgggaggccaaggcaggtggatcacttgagtccaggagttcaagaccagcctgggcaacatggcaggaccccgtctctacaaaaaatacaaaaattagccaggcatggtggtgtgtgcctgtaatcccagcaactcagaaggcagaggcaggtgggtctattgatcctgggatgtcaaggctgcagtgagccaaaatcatgccactgcactccagtctgggcaacagagcaagactctgtctcaattaaaaacaatttataaaaaagacattcgtggtctctgccttcatagaacttctgttaaatgggagaaataggcattaaacatgtaattgcacagataagtctagctacatttgtagtgattgctataaaagaaaagttccaggtgctgtggagatattacagtagttccctcttatccatggggtatacgttccaagatccccagtggatacctgaaatcacagatagtaccagactctgtatctactgtgttttttctatctgataaccaagaagactactaagtaataagtgggtatcatctatagcgtggaaacactggacagagggatgattcacatcccaggtaggatggagcagggtggtgtgagatttcatcatgctactcagaatggcacacgatttaaaacttacaaattgttttatttctgggattttccatttaatatttttggaccatggttgactggggtaactgaaaccatgtaaagtcaaacttgggataaacggggactatgtaacaaaaactctgtctaaagttaaaaaggccattttgagagagctgtttgatctgagacctaaaaagtgagtgggaattagccaagggagaggtgttccaggcagaaataaccacacatgcaaagcccctgaggttactataagagcttggcacatttaaaaagctgaggtttgcctcattaattttattgtatttcataccagcacttatttatctgttcctctattgacaaaaaaaaatttagtttatttccactttttgactattctaaacagtgttacattgaacttctctgtatatataacttaacaacttttaaaaatactgtccctcatgagctcccatgaatcagtaaaaatttactcctgatttgtatttcttttggttttaaatatcatcatgtactgtgcattgctttttgtaatcttaatatatgaaatctgagacttagctaattgaaaatgcaataagtaagtcctatttatggaagcttgagatgcatacttagtttacctcgtatttgggaatacctactaggaaaactcagcctaattttattacatgcacctacccaaactgaaagagaagggacaagggaccatcttaagctaccaaagcattctattttgtgaggaaatatctctttactctttattggtaaaatgtgtttttaagaacagctctctaaagcagccttctcaaagcagttctcacccccagactctctaaattggattatctggggatggagctgaagtacctacactttaaacactcccctctccacactacctctgccaatcaatttttattcaccattgaaaaccaaagctctagaatatatgaatattgtaaattgggggaaagggtgtatgtttcctttgccatattgacttgaatatgtttattccatagaataagggatttggaactcaaacacctattatttatgtttaaaaaagttatttcaaagtagtgtactttatcagtcacagctgatacatttgtctgcaaattattggacttttacagttaactgagttgatacttttttcatttttgttaaggactcaactaaagaagtttcttggaaaatcagtaaagagagcaaagcaccttgctgaggaatatggtgaacgtgctataaataaagttaaaagtgttagagatgaaggtgagttaaaacagaacatttcaactaaacattcaattaatttgtaatcgtctaaatttagcctgtagtttgtaagaagcattctatttaaaatagtaaacctttatagctgacatcttagtatttcaataaataaggtactctatgacttaattttatgagtgtgaagaaaaatggatttatacatattttgtgacttttgacagtctgaaatggttgagtgttaaataatcagttatgaattagtttcgtttgtttgtttgtttgtttatttgagatggagtcttactctgttgcccaggctggagtgcagtggcgcgatctcggctcactgcaagctccacctcccaggttcacaccattctcctgcctcagcctcccgagtagctgggactacaggcgcctgccaccacacctggctaattttttgtgtttttagtagagacggggtttcactgtgttagccaggatggtctcgatctcctgacctcgtgatctgcctgcctcggactcccaaagtgctgggattacaggcgtgagccactgcacccggccataaattagttttttaaggctatttggttttgggtttttcttttttctttttttttgagaaagtcttgctctgtcgcccagactggggtggaatggcatgatcttggctcactgcaacctccgtctcctgggttcaagccattctcctgcctcagcttaccaagtagctgggattataggcacacaccaccacacctggctaatttttgtatttttagcagagacagggttttgccatgttggccaggctggtattgaactcctgacctcaggtgatccacccacttctacctcccaaaatgctggaattacaggcatgagccaccacgtctggccaaggctatttttttcttttttggagatggagtctcgctctgtcacccaggctggagtacagtggcacgatctcggctcacttcaacctctgcctcctgggttcaaacaattctcctgcctcagcctcccaagtagctgggattacaggcacctgccaccacacctggctaatttttgtatttttagtagggacagggtttcaccatgttgcccaagctggtctcgcactgatgacctcaggtgatctgcccacctcagcctctcaaagctctgggattacaagcgtgagccaccgcgcctggccagctatttggtttttacaaatacagtcagtcctccatatccatgggttccacatggagggattcaaacaaccacagatagaaaaatatttttaaaaatatataaaaaataacaatgcaacaataaaacataatagaaaaaataatataacaactatttatataacatttacactgcagtagatattataagtaatctagagattatttaaagtatacagggcgaggcatggtggctcatgcctataattccagtactttgagaggccaagacaggagaaccgcttgaggccaggagttcgagactagcctggtcaaacatagtgagaccctgtctctactaaaaaataaaaattagctttgtgtagtgacgtgtgcctatagtcccagctactcagaaggccaaggagcaggattgcttgagcccaagagttcagggctgcaatgagctatgattgcaccattgcactccaacctgagaccctgtctttaaaaaagaaagcaagtacgtgaaaggatgtgcataggttatatgcaaataccatgccattttatgttaagggatttgagcattcgcagattttggtacccatagcaggtcctgccatggatactggggaataactgtattttcaaaattaggtagggctgggtatgatggctcatatctgtaatcccaacactttggaaggctaaggcaggaggatcacttaagcccaggagttggagaccagcttgggcaacatagtgagacccctgtttgtataaaaataaataaataaatttttttaattaggtaaattttctaaatttgcacatatcttaacctcctatgcttttgtcattattgtactcatttgttttatttaatgaaacttacatagtacttattcagtgcctgggactgtactaagcacttttacctgtattaattcatttaatcccatagaaaccctatgaggtaagtaccatcattatccccatttgatagatgagaaaactaagaggcatcgaaagttgagtaacttgcctgtggtcacacagataataaatgacagagctggatttgaacctggcagtctggcattagactccatgtttttaaccagtatgttatataataaataaattttgctcttccatttaatgaattttcttggtatgcaggaaatatgaaattatgataatagcaatatctacattagctagtagtgatttctgttgcttttctgttcagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatggtaagcaactttttcattttttaggattgatactgtttttgttaagagaaatactttggcttctacaaaactatctctttctatgtatgtaactttgctagcctgactcaagaacggggaatttatgttaacatgatttaatgaataggtaatgcaaagtctatctctgaattattccagaagtgacttatcggccaggtgcggtggctcacgcctgtaatcccagcactttgggaggccaagacaggcggatcacttgaggtcaggagttcgagaccagcctgaccaacatggcgaaaccctgtctctacgaaaaatataaaaattagccaagcatggtggcgggtgcctgtaatcccagctacttgggaggctgaggcaggagaattgcttgaacccaggaggcagaggttgtggtgagtcgagtttgtgccactgcactccagcctgggctacagagtaaaaaactccgtctcaaaaaaaaaaaaaaaagaaagaaaggagttattgaataagtaaactctcaggctgtatcactaagaaagctatgcaaaggcaccaaactttaaagcagttagattagagggtgtaactttgaaaaatgtttaaaatgctcccaaccatattttaaataatttacaaaatatatcagaagctcaatatatgttgtaaagtgagatattcagctaaaacaaggagagaggtaaaagttcaagttctcctttagagttcaaatgtaccaatgtagatgcaattgcacaaactgtattgtggttaacccctgaaaatgctaggaacacaaagaaggcagtgataaaatttagatctgaataaataatactgtgcccttgatcagggaatctgtttacattttaagtctaaaagttggcttaactagaatgaagcaaccataaatatattggatggcaaccaaattcaaatttaaattttgatgtttacagataaatgtttgagttgattttagtattttccttaaggaaattgatgaatttcctagtactgtattgactcgttatttcctgttttaaataaaatctcatcgtagtaggctccaaatgactcatttttaatacacttgaattttgtagaagtgaatggttatttcaataaatgggctgtggcataatctttttgatacatctgaatgtgtatataatagtatttcttgtaataagatttggtctttccaacttaagaggttcatgttctttctccctgctcctccacccccaccacacacacatactttcctattgttctcagtatctagagattctggtcatatactttgaaaccttgtttctagagagaaaagtaggatgagaccacaccactccaatacaactacctttttttttttttctttttgtggcagagtctcgctctgtcacccaggctggagtgcaggggcgggatctcagctcactgaagcctctgcctcctgggctcaagcagtcctccctcctcagcctcctgagtagctgggaccacaggtgcgcaccaccatgcctggctaattttttgtattttttgtagagatggggtttcgccatgttgcccaggctagtctcaaactcctgagctcaagtgatccacccgcctggacctcccaaagtgctgggattacaggcgcgtgccaccacgcccggcccattccaaaactgtaatacttctaagtgctggatgctatacgggtcactgccaaggtgggctttagtcttcctcagtcctgctcagttgttagtgctatgctgagggctctgccacccatctttacgttcagctaggggactaagatccccagctaggatttgtgcttttccaatgaagatttctgaccactttagaactcccatttctgttaatatgtggacagggtttgagttcttgaagttgttagtttagattatggaacactacaactatcttaccctacctttcttgtgaaagtctacttttgtggtattatagcaccattgaacttttggacttaagtagtgttagcaatttgagcattatcttagtatatgtaatttggcgtaattttaaactttggctttaaagtaatgtctctattttattttatttattattatttttagatagagtttcgcttttgttgcccaggctggagtgcaatggcgcggtcttgactcactgcacccttcacctcccaggttcaagtgatcctcctgcctcagcctcctaagtggctgggattacaggcgcccgccaccatgcccagctaatttttgtatttttagcagagatggggttttaccatgttggccaggctggtctcgaactcctgaccttaggtgatccacctgcctcagcctcccaaagtgctgagattacagacgtgagccaccatgccaggccaaaagtaaagtctctaaaggtgtaaagtattaactttgaaacttcttttgttttcatagggagctgtttggaccatgaaattttctcactgtggccgattacttgcctcagctggacaagacaatgtagtgagaatatgggctttaaaaaatgcttttgactatttcaacaatatgcgaatgaaatacaatactgaaggtatttttcatctatttaaaaatctacagaaacctgaagtttttacattttaggtatactgatgccctacttttctggcagtcatttgcagcaaccactacttatgataatagccaaaaacttgaaagtaagacagacgtcagtggcaaaaagtctctaaacccaatgaaaagagctgccacaaagcttttgatttattcctttccaggtgtagtgtgtagttaatttcatcaactattgagaacatgatatttggtttcctctggcaaccttcagttctatcctaggttaaaatagaattgctaattaaactggaaaaagaatgaaaatcatatatatccagtaagtaaaaatgattaaggaaaaagtcatggaaaatgaatgtgaattgtcaatatatcaagggatatatgaaaaaatgttgaaaagagaagcctcagaacattatgtacacactgattacaactatgtacagatatttatgtatcatggtgttatcaggaaagtatgtagaactgatgtaaatttgggctttaagttcatgggattcttttctaataactatttaactgtgtaataagttttttccacaccctccccgccatcaagtaaggctgcaaacgagaagtaaagcataggagaaaggagaagaaaggtggccatgggtgagagtatatagtcaaagcaccaatttgaggaacataaaagtctagggagattcactaaactggcaagctagacctcatatacttgagtaaatcctgtgagtattgcttgcattatgtttcagtacttagttgaagatgataataatttgacaagaagttaaactgtgtttactatatggtgagtttttctagtcctagctgtgtgtcatttcttttactgccctgccaagagcaaaaagactattttcagtggcccttgagactaaccccagccctgaacctttctgctcctttattgttcctcttgctacttgtcatgattaataagaatgtgttctattcgaatactgaggatttaacggtattttgtttactaaagtagggaaatggttaagccattttatgaagtttttatgtaaaaatgattgaaacaaatattttggctcctatagggttatgcctcaattgttagtatttttctagaatactgtattctctaactattagacattgctgtgtcattacttctggatgttatattttggtgggtctgtgtgtgtacatacatgccttttttacaattattatgttgtttttaggacgtgtgtccccatcaccctctcaggaaagtctaagttcatcaaaatcggatacagatacaggggtatgcttattgttttatggttactctgttttcaggtatgatttaatttgtttaccataaagtatttttgtgtatcagaaattacagttgcatgaagacacttaatataaaattaagatgtatcattagaaccaagagtttcttcaattagaagaaattagcaaatgaaaatttttgatatttaaaggttgccagacagtgaatactattgctcagggtactataccactaatgtaaacttaaataatacaaaagcccctcccctcaaatccatgttagacatttttaaaataatgataatagatacccaaataagaggtaattaaggaaagaaaaaatatatttaagtattttaattttctaatcttcttggtttaataaacactttatcacagtttcagataaggtatcttaatgattttcatttggttttagagctggaaggttaaatataaccaattttaaacctataaagcagaatacacaatattgtactaagttgtcacctgtgttttttgtgtgttgcattaggtaagggtgatataaacaagagaacctaaaatgtctacctgctcaacagtattttcctgagatttcattggctccagtatttgacactacgttttctccttctcctggctttccatggttctgtttccctttgttctcttatactcccactgtttcttcttccatctccttacatttactgtttctcagggtctgttcttggccattttcaatagacatatttatgctcttcttctagtcctgaactggctttagatctgtaattctttgtttactttcagtaactttatgatttttaaacaagaacattattgtgcttgctgccttttcacataatatataggatctctttatctacatgtaatccaaccacatcaactaataggtccaaaactaaactccttcaacaaatgttttctgagtgcctgctatatgtggcagacactgctacatgctataaaatcaaatgagacatattctctgtcctcagggatcttgtgaactagtgaaatgggtaaactcacaattacagtattagatggtgatattctacagaaggtactacacaaaaataggttagccttataaatcacagtgttaggaatagtttcctggaaacttgttatttgagctaggatttagctatatgagagaagaaaggaaggagcgtgtcagacccagggactagcaagtgcaaaagcatggaggctagtatgttaaaggtactacaaggaattacacatggctgggaaaggtgcatttgtgagattggtgggagaggtaggcaggagtggaattttaaatgactttttgtgatgaaccaagatggaactttatcctgcaaactactgggagcagggtggggctttgaaggatttcactcagaggcataattaccatgttcagatttttgttttagaaagagtattctggtagtattgtgaaggatagactaggtgggggcttcaggtttgagacagggagaccatgtaagaggctattaacccagagaaatggttacttccgattttgatgattatgataccagtagagctagaaactgtaaagataagctgaattgagagatgtaaaataagtctaatttgtaggacttggtgactgactagctggggtagtaaaagtgagtagcctgggatgaatcacaggtgtctagcttgcgtagttagctacatggtaatggtcactcatagaaatattttttatattttaatttttccataagttattggggtacaggtggtatttggttacataagttctttagtgattttggtgcacccatcacccaaggagtatacactgcacctatttgtagtcttttattcctcaccctcctcccactcttcctcccaagtccccaaagtccattgtatcattcttacatctttgcgtcctcatagtttagctcccacatatcagtgagaacatacaatgtttggttttccattcctgagttacttctcttagaataatagtctccaatctcatccaggttgctgcaaatgctgttaattcattcctttttatggctgagtagtattccatcgtgtatacataccagtttctttatccactcgttgattgatgggcatttgggttggttccacgtttttgcaattccaaattgtgctgctataaacgtgcgtgtgcaagtatctttttctaataatgacttcttttcctctgggtagatacccaatagtgggattgatggatcaaatgttagttctacttttatttctttaaggaatctccacgctgttttccacagtggttgtattagtttacattcccactagcagtgtagaagtgttccctgatcaccacatccacgccaacatctattttttgattttttattatggccattcttgcaggagtaagatggtatcacatcgaggttttgatttacatttccctgattattgtgatgttgagcattttttcatacgtgtgttggccatttgtatatttttttgagaattgtctatttatgtccttagcccactttttgatggactgtttttttcttactgatttgtttgagtttgttgttcattctggatattagttagtccttagttggatgtatagattgtgaagattttctcccactctgtgggttgtctgtttactctgctgactgttccttttgctgtgcaaaagctcgttagtgtaattaagtcccaactatttatttttattgcatttgcttttgggttcctggtcatgaaatccttgcctaagccaatgtctagaagggtttttccaatgttatcttctagaatttttatgctttcaggtcttagattcgagtccttaatccctcttgagttgatttttgtataaagtgagagatgaggatccagtttcattatcctacacgtggctagccagttatctcagcaccatttgttgaaaagggtgtcctttccccactttttatgtttttgtttgctttgtcaaagatcagttggctgtaaatatttgggtttatttctgggttctctattgttttccattggtctgtgtgcctatgtttataccagtaccatactgtcttggtgactatggccttatagtttgaaatcagtaagtgtgacgcctccgtatttgttcttttgcttagtcttgctttggctgtgtgggctcttttggttccatatgaattttagaattgttttttctaattctgtgaagaatgatggtggtattttgatggggattgcgttgaacttgcgattgctttttttttttttttttttatgttccatggttttgtgtttttttttttccattactggatatatacccaaaggactataaatcatgctgctataaagacacatgcacacgtatgtttattgtggcactattcacaatagcaaagtcttggaaccaacccaaatgtccaacaataatagactggattaagaaaatgtggcagattgctttttgaagtatggccattttcacaatattgattctacccatccatgagcatgggatgtgtttccatttgtttgtgtcgtccatgatttctttcagcagcgttttgtagttttccttgtagatgtctttcgcctctttggttaggtatattcctaagtattttatttttttgcagcttttgtaaaagtgattgagttatcgatttgattcttcgcttggttgctgttggtgtatacaagagctactgatttgtttacattaatcttgtatctggaaactgtgctgaattcttttatcagttctgagctttctggaggagtctttagggtttccgaggtaaatgatcatatcgtcagcaaacagtgacagtttgactttctctttaccccatttgaatgccctttatttctttctcttgtctgattgctctggctaggacttccagtactgtgttgaagaggagtggtaagagtgggcatccttgtcttgttccagttctcagagggaatgctttcaatttttccccattcagtattatgttggctgtgggtttgtcatagatggcttttattacactgagatatgtcacctgtatgctgattttgctgagagttttaatcataaaggatgctggattttgtcaaatgctttttctgcatctattgagatgatcatgtgatttttgtttttaattctgtttatgtggtgtatcacatttattgacttgcatatgttaaaccatccctgcatccctgctatgaaacccacttgaactgggtggattatcttttcgatatgttgttggatttggttagctagtatgttgttaaggattttagcatctatgttcatcagggatattggtctgtagttttcttttttggttgtgtcctttcctgattttggtattagtgggtgatgctggcttcatagaatgaattagggaggattccctctttttctatcttgtggaatagtgtcaaaagaattgttaccaattcttctttgaatgtctggtagaattctgctgtgaatccatctggtcctggactttttttgagatggagtctcactctgttgcccaggctggagtgcagtggcgcaatctcagctcactgcagcctccgcctcctgggttccaacgattctcctgcctcagccttcctggtagctgggattacaggcacacaccaccatgcccggctagtttttgtatttttagtagagacgaggtttcaacatgttggccaggctagtcttgaactcctggcctcaggtgatccgcctgcctcggcctcccaaagtgctgggattacaggcatgagccatcgtgcccagccagtcctggactgttttttttgttgataatttttaaattaccatttcaatctcgctgcttgttattggtctgttcagggtatctatttcttcctaatttaagctaggagggttgtatttttccaggaatttttccatctcttctaggttttctagtttatgtgcataaaggtgttcatagtagccttgaatgatcttttgtatttcagtgatgtcagttgtaatatctcctgtttctcttcttaatgaggttatttggattttctcttttattttcttggttaatcttgctaacagtctatcaattttatttatcttttcaaagaaccagctttgtgtttcatttatcttttgtattttttgtttgtttcaatttagtttaattctgctctgatcttggtaatttcctttcttctgctggctttgggtttggtttgttcttgtttctctagttccttgaagtgtgaccttagcatgtcagtttgtgctctttgagtctttttgatgtaggcatttatagggctatgaactttcctgttagcaccacctttgctgtatcccaaaggttatgatagattgtttcattattgtcattcagttcaaataattttttaatttccatcttgatttcatttttgaccgagtgctcattcaggagcaggttattttatttccatgtatttgcacggtttcgaaggttccttttggagttcatttccagttttattccactgtagtctgagagagtgcttgatataatttcaattttcttaaatttattgaggctcgttttatggcctatcatatggtctatcttggagaaggttccatgcgctattgaatagaatgtgtattctgcagttgttggatggaatgttctgtatatatatctgttaagtccatttgttccaaggtatagtttaaattcgttgtttctttgttgactttctgccttgatgacctgtctagtgctgtcagtggagtattgaagtccccaactattatcgtgttgccgtctatctcatttcttaggtctattagtaattgttttataaatttgggagctccagtcttaggtgcataaatgtttaggattgtgatattttcctgttggacaaggccttttactgttatatcatgtccctctttgtctcttttaaatgctgttgctttaaagtttgttttgtctgatataagaatagctacccctgttcgcttttggtgtccatttgcatgaaacgccttttaccacccctttaagtttatttgagtccttatgtctcctgaagacagcagatagttggttggtgggttcttatccattctgcatctctgtatcttttaactggagcatttaggccacttacattcaatgttagtattgagatgtgagatacctcatagtgttatttgttgcctgtgtaccttggttttttttgtttttgctttttaacttacatttttgttttataggttctgtatgatttatgctttaaagaagttctgttttaatgtgtttccaggatttgtttcaagatttagagctcgttttagcagttcttatagtggtggcttagtagtggcaaattctctcagcatttgtttgtctgaaaacgactgtatctttccttcatatatgatacttagttttactggatacaaaattcttagtgataattgttttgtttgaggaggctgaagatagggccccaatcccttctagcttgtagggtttctgctgagaaatccgctgctaatctgttaggttttcctttatacgttacctggtgcttttgtctcacagctcttaagattctttcctttgtcttaactttagataacgtgatgacagtgtgcctacgcgatgatcattttgtgatgaatttcccacttgttctttgtgcttcttgtatttgaatgtctagatctcgagcaaggccggggaagttttccttgattattcccccaaatatgtttttcaaactttcagacatctcttcttcctcaggaacatcagttattcttaggtttggtgtttaacataatcccagacctcgtagaggcttcattcatattctcttattcttttttctttgtctttgttgtattgggttaatttgaagaccttgtctttgagctctgaatttctttcttctacttgttcaattctattgctgagactttccagagcatttttcatttctataagtgtgtacagtgtttcctgaagtttttattgttttttttctttatgctatccatttccttgaatatttctcccttcacttcttgtatcgttttttggatttcactgcattgggctttgcctttctctggcgcctcccagattaacttaataactaacctcctgaattctttttcaggtaaatcagggatttcttattggtttggatgcattgctgatgaactagtgtgatttttcgggggttgttaaagagccttgttttgtcaaattaccagagttggttttctggttccttctcatttgggtaggctctgtcagagtctagggctgaaggctgttgttcagattcgtttgtcccactgggtgttcccttgatgtagtactcttccctttttcctatggatgtggcttcctgtgagccgagctgcagggattgttatctctcttctgggtctagccacccagcaagtctacccagctctgagctggtactggaggttgtctgcagagagtcctgtgatgtgaaccgtctatgggtctctcagccgtggataccagcacctgtaccagtggaagtggcaggggggtgaaatggactctgtgagggttcttagctttggtggtttaattttctatttttgtgctggttggccttctgctgggaggtggcgctttccaaagagcatcaagctatggtagtatggattggaaatggtggtgggtggggccctagaactctcaagagtatatgccctttgtcttcagctaccagggtggataaggaaggcccatcaggtgggggcagggctaggtgtgtctgagctcagaatctccttggttgggtcttgctgaggctgctgtgggggatggatgtgatgttcccaggtcaatgaagttgcgtacctaggaagattatggctgcctctgctgagtcatgcaggttgtcagggaagcgggggaaagctggcagtcacaggcctcacccagctcccacacaaacggaagggccagtctcactcccaccatgccccctcaacagccccaagtctgtttccaggcagtaggggatctgggcctgagaacttgccccaggctactcacctcccagctgtgaaagaaaaaggcttggttctttccccacctatggagtctgcacaccggattcgtgccctcccccttctggccaggaggcttctcgccagttcaaattgttacaaagttcagctggagacttccttctccctatagtgtttcccctcctattcctctggctgccctcccgaaggatccctgtggtgccaggcaggaatggcctgcttgaagacccagcgagctcccaaggctttcctgctgcttcctctacttctatatttcgctgggctctctaaattgactcagctccaggtaaggtcagaaacttatcctgcaaacagacgttcagtttccccagtgggggtgtgtgttccggagaggaggatctccctttcccacttctgcagtttgggcactcacagtattcggggtgtctcctgggtcctgcaggagcattctgcttccttcagagggtctgtgggttctcttgggattcctagttctttcttgcagtcgatctgcagctaaaattcatggtgtgagcctccgcatgctgctctgtccatctgagtaggagctgcaatctagtcctgcctcctgtctgccatgatggcatcccattatgtttaaaatgtttcttatagatagcatatagttagaccatgtttttttacccactctgccagtttctgttttttaattggtacatttataccatttaaacttactgtaattattgctactttaaactcaaatctgtcatctttatgatcattcattgaaatattttcatcattcacccacaaacctgcttctcctcacttctgaaccttatttagtggcatcaacatctacacgttacctttttaactcaatcaaaaatactccattactttttcttccttacccacatttcaaattagtaacaaattcctagccactctacccccacccacaaatacctgtggaacttaccccctcatccctaattgtcacacacatcgtctaggtcttcaacactcatttaaatgcttgccatagtctcctaattgttttttctgcctctggtctctacccaattcattttctacactgccaccagccagccaggtttttcaaaacagattgactgtgccattgtgtggtttaaaatttttttttcttttttttgagacagagtctcgctctgtcgccgaggctggagtgcagtggcatgatctcggctcatttgcaacctgcgcctcccgggttcaaggggttctcctgcctcagcctcccaaataactggtattacaggcactcaccaccatgcccagctaatttttgtgtttttagtagagatagggtttcaccatgttggccaggctggtcttaaactcctgacctcaagtgatcctcccacctcggccccccaaagtgctgggattacaggcgtgagccaccatgcccagccttgcggtttaaaatcttttgacggccctttatctcccccacaataagattcttccctgtattgcctaatcttaacttttgactcagttccaattccctagtgcctgtgcatcctaccagccgtgcctgatacaggtctgtacactataaacactttcactttcatgtctctgtccctgctgtttgctttgccttcacagggcaaagccctacttatccttcaagattcagctcaaatatcttattattttccctgaatccagcagataaaattgttcttcatttgtattctaatagtacatcataggtacttttatactgatattaccatgtctttcttgttagtctccctggctaggctctgggctgattgaaggcaaagaactgtacttcacagattttagtatccttggaatctaattccattcctgactgtagcaggcccataatcatgttgaattcctgcctgtggaccttattcctattgttccccttatttggatgccttgatcatctttctattcaaagcatgcccattcttcatggcccgcttcctccataaagcctcactgactaatgtagcagagataattttaactgctttgctttagggaaaagggcttgcttttattagtttaatttaccatacagtttccaggcattgattactattaaaaatagagactatctgtagtatcttttattgcgcttatttcagcaatcctacttatagatcctcagctacatccatctaaccccaaacagacctaagtaactcacaattttattgaatacaaagcctttttacatgagaaataacatttatatccattgttttcaggaagagatcatttggggtttgtttcccttctgtcattttatttggggacagttaaaagaggcttctatttcacatgccattagagtttgacaccagaaattatcttctaacctagtgctagccacagtgaggcacagtaaacacaatggagtttatgttcctgatgtgtgtattctttttttcttatgatagtgatatctttttcatctcttttgaagtactttttcagtcttttgtcttagcatctgtgtggaatataatatataaaagtattgtacagtcgaacatacagagtgatgtacccaagatcactcacctgtgcattggtaatgccaagcctagaattctggctactttctgtttctgttaattttcaaaattagctcaataaatgtaagaaagacaggaagaggtgcatgtctaatatgctccattatcttagacacttataaagtagggatttttttaatagttgggttttgcagagactgttagacctcatggcttctaagaattgataattgcatcagattgcaaatatgaatatactgtatccattttaataagtataaaatttctttttgatactagaagctgtaagtatgctatgtacctagaaagtaatgtttttcttgcaaatttatgtttaatgtgcatgactagggaacattagcataggtgttgtagcatttaactgctgcttaaaatttttgagaataggccaggtgcagtggctcatgcctataatcccagcactttgggaggcccaggcaggaggattgcttgagtccaggagtttgagaccagtctgggtaacataacaagactatgtctctatttaaaaaaaaaaaatatatagccaagcatggtggcatgtacctgtagtccagctacttgagaggctgaggcatgaggatcacctgagctcaggagtttgaggttacagtgagctgtgatcaccactgcactccagcctgggcaacagagcaagaccctgtctcgaataaatttttttgagccaggcgcggtggctcatgcctgtaatcctagcactttgaagaggccgaggcaggcggatcacctgaggtcaagtgttcaagaccagcttggccaacatggtgaaacccggtctctactaaaaatacgaaaattagctgggcatggtggcatgtgcctataatcccagctacttgggaggctggggcaggagaattgcttcaaccgggaggcggaggttgcagtgagccaagatcgcaccattgcactccagcctgggtgacaagagcaaaactccgtctcaaaaaaaaaaaaagaaaaatttctgagagtatatcattagaatctagaacttgggtaaaggaagttaactataagggagtgagagaatttttgtgaaatgtaggtatgcagtatttgatacagatttgtcttggtactattaatagcctcactttacaaatgaaggtttagagctgttaagtaactcaacaatttcacacagtcatagcatcagtattagaaccctgctctgtctctagagcttatgtttttaaccattatgctccaatagttgacatcttgaggtctgggactatgtcttcattcactctagagatatttattaagtgcctactatttttattaatcactgttctaggagctagagatatagtaagtgaacaaaagagacaaaaatatctgtgaacaagagacaaaaatagaatggagcatacattctagtggaagaagacagaaaataagtaaattttataatataaagttgttttttttttgagatagagtttcactattgttgcctaggctggagtgcagtggcacaatcttggctcactgcaacctctgcctcctgggttcaagcaattctcctgcctcagcctcccaagtagctggaattacaggcacgtaccaccactcccagctaatttttttgtatttagtagagacggagtttcaccatgttgatcaggctggtctcgaactcctgacctcaggtgatccacccgccttggcctcccaaagtgttgggattacaagcgtgagccactgtgccaggctataagttaattttttaaaccactttattgaggtatgattggtattcaaaaagctgtatgtatttattatatagaacttaatgagtttggagataagtatacaagcatgaaaccatcaccaccgtctgtgccataacccaagcatcacctataaaagtttattctcatcctcttatttattaagtatacgatacagtattgtaaactgtatgcactgtgctatataatagatctctcaaacttaatcattttgaaagtgaaactttgtaccctttgactaataccacctgtttcgccagccccaaggccctcgcaatcactgttctactctgcttctatgagtttgttgtttctagattcatcatataagtggcattatgtagtatttgtccaaaaagtatctggcttaatttcacttagcataatgtcttccagtttcattcatgttatcacaaatgccaggattttctttttatgactgaatagtattctgttgtgtgtatatgccacattttctttatccattcatctgtcaatggacatttaggttgtttccatgtctaggctattgtgaataatgctgcagtgaacatgggagttcagatacctctctgacatactgattttatttactttaaatatatacccagaagtggaattgcaggatcatatggtagttctattttaagttttttcaggaactttcatactggttttcatagtaggtgcaccaatttacattcccatcgactgtacagggttccattttatccacatcttcactaatacttgttatcttatatatatatatatatgtgtgtgtgtgtatgtgtatatatatatatgtgtgtgtgtgtatatatatatatatatatatatatgtatatatatataatgttcatcctaacaggtgtgaggtgatatatcattgtggttttgatttggaaatcaaatcacctgattaattggtgatgttgagcaccttttcatgtactcattggccatttgtatgtcctctttggagaaatgtctatttaggtcctttgcctattttaaaaattgggttatttgtttgaattttggggtttttgacattcagttgtaggggtttcttacatattttagatatcaaccattcattagataaacggtttgcaaatattttctcccattctgtaagttgccttttcatgttgttggttgtttcttttgttgtgcagaagctttttagtttgatacagtcccgtttgtctatttttgcttttgctgctggtgcttttggtgtggtgtcatatccaagaaatcattgccaagtccaatgtcaagaagtttttttcctgttttcttctaggagttttacagcttcaggccttacatttaagtatttaatacattttgagtttatttttgtatatgatgtaatataagagtccaatttcatttttttgcatgtgtatctccaaaggtaatcagttttgtgaagaaaagtaaaacaaagtgggatggcagggagtaaataaggtgggtgagcaaagcttcactgagaagttgttgttcgagcaaagtacaaaggaggtaaggaaatgatcatatgataagaccattccaggtagagacagcagcaagtgaagctgctataaggcaggagttctggtgtgctcaaaaaacagcagcaagggcagctggagccagtgagtgagaaggagaggaaaatagaaaaggaaaacatagagatgtcgatgcggggatcagaacatataggacattgcaaggactttggcttttgctctgagtaagatgggaatcagtgggttttcaaacagagaatgacataatctgatttattttaaaaggatcattctgacttttatactgagaacaaactataagaagataaggaccaggcatggtggcttatgcctgtaatcccagcactttgggaggccaaggtgggcggatcacctgaggtcaggagttcaagaccagcctgaccaacaaggtgaaaccctgtctctactaaaaatacaaaaattagctgggtgtggtggcaggtgcctgtattcccagctcctcgggaggctgagacaggagaaccacttgaacctgggaggtggaggttgcagtgagccaagatcacaccactgcactccaacctaggtgatggagcaagactccatctcaaaaaaaaagataagaaatgtcttgttaattctggtattccaaataagcaatacagtatatctgctacatattgtatgtgctaatgaatgtcaaaagccttataattttccatagcaatccaactttataatatctttagataggccgggcatggtggcccatacctgtaatcccagcactttgggaggccgaggcagatggatcacctgaagtcaggagttagagacctgcctggccaacatggtgaaaccccatctctactaaaaatacaaaaaaattagctgggtgtggtggcatgtgcctgtagacccaactgctcgagaggctgaggcaggagaatcacttgaacccgggaggcggaggttgcagtgagctgagatggtgccgctgcactccagcctgggcaacagagcaagactccgtctaaaaaagaaaatctttagataattagaacatttgagtgtggattagatattagatgatataaatggtattttttaggtatgagaatggcacggtaatcatatttaaaagaagggttatcagaggtatatatagaagtatctactgataaaattattagtgtctagatcttgctttcaatgctgcagcaaaaataaacaaaaatgggaagactgataaagtaggtaaaattttgataattgttaaagcaggtgatggatgcatggggttcaatatattatatggagttcattatactcttctatctacttttgtatatatttaaaatgcccataataaaaagacagtggccgggcatggtggctcatgcttgtaatcgcagcactttaagaggccaaggtgggaggatcacttgagcccaggagttcaagaccagcccaggcaacaaagagagaccctgtctctacaaacaaacacaacaaaaattagctgagtgtggtggcacatgcctgtggtcccacctactcaggaggctggggtgaaaggatcgctggagcccaggaggcggaggttacagtgagccgaggccatgccactgcactctagcctgggcaacagaacaagaccctatctcaaaaaaaaaaagaaagaaaaatatatgtatataacattttacttggtaattctacctttaataatttatcataaaggaataatcaagaaaaaataaataccaaaaaatagaacaaaaaacaaaaacaaaccaaaaaattattagatattctgaaagataagtaagaagattctcatcttagtgttttcataatagctaaaatttgaacaacctaaatttctaacagttggaaaataaaaactggtataacccatgcagtaaaatacatgcagtccttaaattgttttcaaagactatttaatgatgttaaaaatggtcacaataaaacataaagtgaagaaagcagaatgtgaaattggatacaatattaccacaattttgactaaaaagtacctataaatatacatatatattttaagggataagagtctccctctgtcacccatgctggagtgctgtggtaccatcatagcatgttgtgacctcaaacttctgggttcaagcaatcctcccacctcagtctcctgggtagcttgtgctacaggcaagcaccaccatgcctggctttttttttttttttttggggacggagtcttgctctgtcacccaggctggagtgcagtggcgcgatctctgctcactgcaagctccgcctcccgggttcacgccattctcctgcctcagcctcccgagtagctgggactacaggcgcctgccaccacgcccggctaattttttgtatttttagtagagacggggtttcaccatgttagccaggatagtctccatctcctgacctcgtgatctgccctcctcggcctcccaaagtgctgggattacaggcgtgagccaccacacccggcaaaatgggcagacatctgtaactaactcattagttcatattatttgagagaaactgctctagccgtctcagtacatcctctccaccatgaagtaagctccatgagggcaggaatcttttttttttttttttcttttcgctctgtcgtccaggctggagtgcagtggcacgatctcggctcactgcaagctctgcctcctgggttcacgctattctcctgcctcagcctcccgagtagctgggactgcaggcacctgccaccaagcctggctaatttttttgtatttttagtagagacggggtttcaccgtgttagccaggatggtcttgatctcctgacctcatgatctgcccgcctcggcctcccaaagtgctgagattacaggcgtgagccactgtgcctggcctatttttttaattaaaaaataattttgcggctaggcacagtggcttattacacttgtaatcctggcactttgggaggccgaggtgggtggatcagttgagatcaggagttcaagaccagcctggccaacatggtgaaatcccatctctactaaaaatacaaaaagtagccaggtatggtgaccgccacctgtaatctcagctacttgggaggctgaggcatgagaatcgcctgaacccaggaggcagaggttgcagtgagccaagatttcaccactgcactccagcctgagtgacagagcaagactccatctcaaaaaatagtaataataataataatgattatttttgtagagacagtctcactgtgttgtccagtctggtctcaaactcctggcctcaagcaatcctcctgcctcagcctcccaaagcactgggattacagggacgaactaccgtgcctggccctataaatatttatagataaaagactttgaggaaatatgctaaattattaataatattctttatctctgagtgataggatttcacatcttttgattctttatactctgtttttctaaagttttcttttatgcttacctacttttattaaaacaaatggaagaggggaatgtaaattagttcaaccattatggaagacagtgtggcaattcctcaaagacctagaaccagaaataccatttgacccagcaatcccattactgggtatatacccaaaggaatagaaatcattgtgttataaagatacatgcaggcatatgttcattgcagcactattccatatagcaaagacattgaatcaacaaaaatgcctatcaatgatagactgggtaaagaaaatgtggtacatatataccatggaatactatgcagccatacaaaggaatgagagcatgtcctttgcagggacacggctggaactggaagccattatcctcaacaaactaatgcaggaacagaaaaccaaacaccacatgttatcacttataagtaggagctgaacaatgagaacacatggacacagggaggggaacaacacacagtggggcctgtcagggggatgggaggagggagagcatcaggaacaatagccaatgcatgtggggcttaatacctaggtgatgggttgataagtgcagcaaaccaccctggcacacgtttatgtaagaaacctgcacattctgcacatgtatcttggaacttaagaagtattattttttaattcaaaacataaaaaaaaagagactataaaagtttcaggtttaaactttttgacccagtaataaccctaatataaggataaggaaataggccaggcacagtggctcacgcctgtaatcccagcactttgggaggctgaggcaggtggatcacttgagatcaggagttcgagaccagcctggccaacatagtggaaccctgtctctactaaaaatacaaaaattagatgggtgtggtgctgtgtgcctataatcccaggttctcgggaggctgaggcaggaggattgcttgaacccaggagacagaggttgcagtgagccaagatcgtgccactgcactccagcctgggtgacagagcaagactcagtctcaaaaaaaaaaaaaaagataaggaaatagtcaaatgtggataaagattcaaagattcatgttccagggcattcattgaattgctgggttttatttatttgtttgtttttgttttttgtttgtttgtttgtttttgagacagagtctcgctcaggttctagtgattctcctgccttagcctcccgagtagctaggattacaggtgtgcaccacgcccggctaatttttgtatttttagtagagatggagtttcaccatgttggccaggctggtctccaactcctgacctcaggtgatccggctgcctcagccttccaaagtgctgggattacaggagtgaaccaccacgcctggccgaattactgtttttattagcagaaaagttggaaatgtctaagtgaccaacaaaggaagaatgattaatcgtgatgcatccatattatgcagctactaaatgttttcaaagcatgaaatacagaaaatgctcatggtataataggaagattggtaaatttcatgtttaatatgatttcaaatacattttttaaaaatgaaagattgaagagagacaaaacgttagcaggtttggggtgatgttaatttttctgtttttttttttttgttctccgaattgtctacactgatcatgtattattttataacttaaaaaatttaggctgggtgtggtggctcacacctgtaatcccagcactttgggaggccgaggctggtggatcatgaggtcaggagttcaagaccagcctggccaagatggtgaaacgccgtctctaccaaaaatacaaaaattagccaggcacggtggcaggcgcctgtaatcccagctactcaggaggctgaggcaggagaatcacttgaacccagagggcagaggttgcagtgagccgagattgcaccactgcactccagcctgagtgacagtgagactccatctaaaaaaaaaaaaaaatttagtctggtcatggtggctcacacctgtaatcccagcactttgggaggccgaggcgggtggatcacctgaggtcaggagttcaagaccagcctggccaacatggtgaaaccctgtgtctaccaaaaatataaaaaattaaccaggcgtggtggcatgtgcctgtaatctcagctacttgggaagctgaggcagtagaatggcttgaacttgggagacagaggttgcagtgagccaagatcatgccattgcactccagcctaggcaacaagagtgaaactccgaatctgatttgtatgtaatgagggaagcctgtttagctgtatgtctcccagcagtgctcactagtctggtagtaaaattgaggggggcgaggatggtagtcatctagcattagaagtgcttggcaaaggttacaggagtctgtgttggtggtctacctccatggttgatgtgaagatgttttttataaactgtaaagttctacacgaataatagtggtagtttttaatctatccccatgccactgtcctcattcaagccctcattattcttacttaaacttattgactgcttttcctgcctccatgctctctccaaaccatcttttacattactgcccagagttctttttctgaagcaccggtaagatggtggtggttttttcctttcagaaacctgtgttggctctccatgtctgaacttttaagccacaaatttgaggcctttttattgtttattttattttatttatttatgtatttttggagacagagtttcgctcttgtggcccatgctggagtgcaatgctgtgatctcagctcaccgcaacctccacctcctgggttcaagcgattctcctgccttagcctcccaagtagctgggattacaggcatgcgccaccatgcccagctaatactgtgtttttagtagggacggagtttctccatgttggtcaggctgatcttgaactaccgacctcaggtgatctgcctgtctcggcctcccaaaatgctgggattacaggcatgagccaccgtgcctcgccaaggcctttttgaatgtgatcccaaagtacctttctaccctaatttctgactacatctccatatactgttttctctgtcctcatcatcctacctacctttccctaaatatgcgaggcttagctaaccctctgttcttgctcatgctatgtcatgtaaaacatttgaaggacaaactttggacttacagttagatgacttgtattactgctttggttctgctgttcacaggtggctgtgtggcctttaatatattattttaacctctttgatcctcaggggtttgttgtgtgttttgtttgtttgtttgtttgtttgtttttactaatttcttcatctttatactgttaatacctacctcaaagaattgttagaatttattcagataatgaatacgaaagcacgttgtaactagatgcacagtacacatgtatggcattattttctacctacctctgtcagtatgcttttgacttcaaataacagaaatccaactgaaaatggcttaaacaatgaggaagcaactctggaggtaaggcggttccagggttggttaattcagcagctcagtagcatcgtcctactatctccctgctttgtactctttgttttgttcctttcggctttttacactatggtcttaagatggctgctacagtcttagttgtcacatgaagtcagcaatgttcagatgcaggaaaggaggagtcctattagtatgaccctctttaagggtgagaaaatctctctagaagccttccctcatccccaccccataaactttgcccaatgtctaattcatggaaattgtaccacatgcctaaccagtcatcactgggaagggaaatcagctaatcttcattagcttagaccaatcatgattcactcgctggtactggccgtcacctctcctgaaggaacagatgcttattaggggctctattagggagggaaaagattgtgacagcacgatgtcttcagggatgaccctggtttgttagggcaaggagatgaaaggaagaggtgctaagtagtaaatcagcataaaggggagcttgcttttggtgactcaagatttcaatcaggcatcatacaaaatgctgagagaacagatggggtgggaagaatgtgaaactagttttacattgcagtttcaaagtttatctttatatccaaataggtatgcagtggaactgatgaagaccctgatgataaaaacgcaccctttcggcaacggccattttgcaaatataaaggacatactgctgatctccttgatctttcatggtctaaagtaagaaattcttatttgaatcatatagtaattctgcgtataaggagctgatgctgtagtcttaaagcagaatttcttctccgggaaacctcagttttttgtcttaaggccttcaactgattggatgaggcccacccacatagtcaagggtgatctcctttacttaaaatcaactgattataggtattaatcacatgtacagaataccttcacagcaacaactagattggtgtttgattaaataattgagtactagcttaataattaaataattgagtatagctaagttgatacataaaattaactgttataaccaccttcttaccagaattaacaccttttctttgaactcattctccttaacctttctctagcatttgatgatttgatgctattgatctttcttgaactacttgattttggagcactgtatgttctagattcccttcctatctcactgactattcccttgtttccttcatggaggaaatatgtaatagttaaaaaaaaaaattgagaacctgtgcaactatacctgctatgtaccaagtacttttcattcactcaaaacatatctgttgatcattttaccacctggttaagaaatgacccctggagccagactcccaaggtacatattcttcctagtctgccccttacattatgtgaccttgggcaagttatttaacctcaccatgcctcatctgcaaaatagacataataaaaataccttcctcatagtgttataacagggaaagattaactgagctagtaaatataaagcacttgcctagaacataataaatgttcaattaatattagcagtgatgataatgattaactgagctagtaaatataaaacacttgcctagaacataataatgctcagttaatattagcaatgatcgtcatcatcatcatcatcactatctgccaagtagcattttagccactggggacacagacaaaagttaagtactttacatgtgctctgttcgtaccctcaaaacaaccttatgcgattgttgatgtttccttatcaaggatttaaaaccaagggtcatacgtgttaaagaacatgcttaaaggcgtatagctagggagatacgggagtttaggttcaaaccctatgacttcggagcattactctctagcccattccagtgtcacagtagctaatcactacaaggaaacaggatgacaaaaataacaaatgttggacacgttgaaagatttaagaaatcataaattttttatactttccgttttatactttatttccattctatctcttaggaggcagcagtaatatgatttagtatctatccagctacctaattgtctcaagtgagtaatgtgcatttttaaggactggtgccagcctataaaccacctggtcttcctggtccttgacgatacaaatatagaataccagtctgtgaagagataagtgcagaaaccaagagtaaactatttagaagtgtttatggcagttttcacaataagtttatacctgtttaatcttttaaaacttgggcttctattttgtataataatacaaaatggggcttttattttatatgacttttatttttatttcatttttctagtaaatgttttctgtattttaaaatagtttcagtccacaactcattggaaatttaaaaaaacaaaaacaatccttcaccagaaatagtctgagaagcactagtctagatgagttatttcaatgaggtgctgccccatgcaggaatggttcctaaaggtctatcctcatatccccaacccctccaccccacctccatccagaggaaaggaacaaaatttctgcaacaagattctaagcctctccagggtaggaaccagatattattttactgttttttgcttttcaaacaccaactcaaaccagatattgtttctctttaatgtctatcacagtgtttttagtgagttttctatttgttgaaggtgtattttgtgccaataacaagaattaccgtgttaattcttacaataacaaccccgtgaggtagacaacctgattttgtctcgaggaagagattgagcccctgtgacctatctaaaatcacaaaattagttatgggtagaacttagattttaatctaatttatctgacttctaagatcagtgcttagtttaagaacgttatttaatttcgtttatttaataaaaagtatttattaaatacttataaaagaacaagtctttcttaaagaatacttatttggaacaagtcttaacatgtcttcagcaccttcacttaatattttagggatgtcttcatacctctttcatatgctcaaagcaatgagctattgcaggaattgaatacagtcagtttctgttttttgtttttttcttctgttttcttttttttgagacagagtctcgctctgttgccaaggctggagtgcagtggcacgatctcagctcactgcaacctccatctcccaggttcaagcgattctcctgcctcagcctccccgagtagctggaattacaggcgtgggccaccacgcccagctaatttttttttttatttttagtggagatggggtttcaccatggtggccagactgatctcgaactcctgacctcaaatgatccacctgcctcagcctcccaaagtgctgggattacaggcatgggccactgtgtccagccaaataaagtcagttttaatgaacataggttcatggtgtgccataggttaagtttttatacagttggtattaatcaacaggaaattataatgcaaactgcatatactcttaaaaacttttctggaactgagtggatcttgaaaataaaaatgattgttagatatttcaaagattattgtaaatttccaaattctgttttttaattctttacttttaatcataaagtataccatctatttgaaaacaggtataccacaatgtacctacttcatagtgttgctatataatgcgaagaacaatgcttaacacatcgtaagtatgcgatcaatgtcaccattgccttgatttgtttagcacctttaggcacaccaaagaatacagaggtatcatttgagttttctcattcagtataactcatagttctcctccttaaatagattatgttgaggaattaatgagcttctgccagctgaaagcttttgacagatagatgtttgtttcctgggcgatggggccatcacggtgcctaagtcagttacactaccatcttctagccttgaacattctgtgatctattctgaaagatttgacaatttctattctctaattttcttgcctagagtgtgacaggtgcacaataacttttcatttccatgctgcattatagggtaatctttttgaagacattttaaatgacaattagagatctatgtgagttaaaattcaccagtgttatcaatgtgaaaataactgaagtgacaataaaatgaatagatgccttatactgatagctaagttccaatatgtgcaggtgataacaactaaggcacaccttagttctctgctggtgcctggcagatttctttagacattgataagattcatctgaatttcagaacaggtaatgtcaaaaagttttagaatcagtgaaatatggtacttaactgtttgggggaaaataggatcttccaagtgaatttgataatcttttgttctttccgatgctgcatttaacaataacaaaactgttgagatacaaaaaccaaaagttcacttttattgtataaatagggttctttttcatatagtgataacatagtcaatgtcattttccccatagaactactttcttctttcttcttcaatggataaaacagtcagattatggcacatttctcgaagagaatgcctttgctgttttcaacatatagattttgtcactgccatagcttttcatccaagagtaagtaactatttatacatgtttttgttaacctctaaggaaggtgagagaacctgatttctctagagggcaattggactacaggaaaaaaattattaacagctacatagttatgagcaatttaattttgtgtttcattttgctttagaaatgagaaaggaaatattctgctgatctgcattagaaaaactggggatattatatcctaaatctttattaagacatgcaaggtataaataaatgaaataaagtatcctattaaagatgagagatattggagatggaggaagaagagacagcagatggataaatgagaaagggaagtacctaggcagaaataatgagaagattggggagggaagagacagagaaaaagactgaaagaggcaaagacgaaaattcattacaagatacactgaattcatattgttagtcttgatatcccttctttattccttttcagtatagaaaatcctttcatatctttcccccagaaataaagtatttcatatgatttcagccaaatgagaaaaatctgctgtcatggaattgcagacctattgtatgcccttagaggatggagccaccaaatgcttaaggctaaattagttacagatttttgcaactgtaagcaaaagggaaatcacatgttggtgctgactgcactagctctattaagcagaggactcgagctgaccctagcaacaagtttcccttacctaagttggtgttatgattacatttccagtggtgtcctcatctttatatgtttaacacacattatctttttaatgtaacattttaatcatattcacatttcttcatctcccccaaattaagaagactgacttgttttcaatatactttccttccctgagcaggcttgtaacataagcagtgataattccgaacccttgaagacttggttaagggccaggcgcggtggctcacacctgtaatcccagcactttgggaggccaaggtgggcagatcacgaggtcaagagatcaagaccaacctggccaacatggtgaaacattgtctctactaaaaatacaaacgttagtcaggcatggtggcaggtgcctgtagtcccagctactcgggaggctgaggcaagagaatcacttgaacccaggaggcagaggctgcagtgagctgagatcgcgccagcctgggcaatagagcgagactctgtctcaaaataaaaaaaaaaaaaagaggaagaagacttggttaagaattttggtggctcacgcctataatctccgcactttgggaggctgaggtgggaggatggctttaggctgggagttcaagaccagcctggacaacacagtgagaccccacctttatcacacacaaaaaaactatgttaattcttaccagttttgatgatcaagtcattagagtcctgtttctgaataacacccccatccctgttccctatacacacaacaaaaggatggatttaccccatcagcaactgtgagcaaaatctttccatccataaatctttccataactattttagctataaagtatcagcttggaaagagatatttggttgtgttcgttttctttctctttcttttcttttcttttctttttatttatctatttttggagacagggtatcactttgtcacccaggctgtagtgcagtggtgcagtcttggcttactgcagcctcaacttccctggctcgggtgatactcctgcctcagctccccaggtagctgggactacaggcatgcaccactatgcctgcactatgcctagctaatttttgtatttttagtagagacagggtattgccatgttgcccaggctggtctcaaactcctaggctcaaagcgatctgcccacctcggcctcccaaagtgctaggattaaaagcatgaaccactgcacccatccagttgttttccatgtggtattttattatttattaaactttctgttcagccatgtttttttttttttttttttttgaagacagtctccaggctggagtgcagtggcacaatctcggctcactgcaacctccacctcccgagttcaagcagttctgcctcagcctcccaagtagttgggattacagacatgcaccaccacatccagctaattttcatatttttattagagatagagtttcaccatgttggccaggctggtctacaactcttgacctcaagtgatccgcctgcctcagcctcacaaagtgctggaattacagacgtgagccactgcgcctggcccagccaatgattttttatagtgcttttatttggttttattttggaaactataaagccctatttctaaaaatcgtactgacctggagtgtttttaagaggggctaggaaagaatagggtagtgatgcctttttttgggggggaaatatgacttttattataatgttaaaggaagaaaggtagcagagttagaaaagaaatagcaaaatgggccaggcgtggtggctcatgtctgtaatcccagcactttgggaggccgaggcgggtggatcacctgaggtcaggagttcaagaccagcctggccaacatggtgaaaacctgtctctaataaaaatacaaaaattagccggccgtcgtgttgcatgcctataatcccagctactcaggaggctgaggcaggagaattgcttgagccaaggaggcggaggttgcagtgagccaagattgtaccactgtaccccagcctgagtgacagaatgagactccgtctcaaaaaaaaaggaatagcaaaatggagatacacatacatagatgtatgtatgtgacaattctgaattagaagactaagttaaagtatttttacttgttcacctcttctactggtacacattgagtgagcttacattatttgtagattgtctttgacaggtttcagagatgggtaagaataataatctttggcaaggaacagaaacccttagggcagggggatttggggtgggggaaggaaaaaaaaagaagaagaagaatcttggctgggtatggtggctcactcctataatcccagcactttgggagtttgaggcaggaggatcacttgaggccaggagtttgagactagcctgggcaacatagggagaccccatttttataaaaaaatttaaaattagcccggtatggtggtgtgcttctgtgatcccaactacttgggaggctgaggtgagaggattacttgagcccaggaggtcgaggctgcagtaagccgtgatcgagcctctgtactccagcctgggcaacaaactgagaccccatcaccaaaaaaaaaaaaaaagaaagaaagaaagaaaaattcttatgttgccaaaaacaaaacaagcttagtggtaggactgatttagtttaaaggagatttctcaatcctagtactattgacattctttgttacacgggggagagtaggctgtgcgttataggatatttagcagcatccctggtctctacacactaaatactggtagcatcctgatcctcccaccagttttgacaaccaaaatgtctccagataatgctagatgtcccctgcaaggtcagattgccgcaggttgagaaccgctgatttgagagcagaatttgaatgatgaagtaattctctgttgacatggtgttagagttccaaaaatgactggttttgggggccactaactgatgttactctttatccaagtgttacatgtatcccagaggaaggtatgatataggatagtgtttcccatagcatgttcctgaaaggtctagcacctcccgtaaacacgcccccccaaaaaaagtctgtggttaaatatgttgaaaagtgctacctactttatcctgtttggagattcaaaatgcaggttaactgagaatcatgtttaactttttgtaacccagaatttctcaaacttatttgatcacagaaccttcttccatgcaatacacactcaaacactttatctattgacatccatatcttgcaaaacagcagtttaaggatatgataattagaattttatttctccaaagtgaatagtgaggtttcttattgttgttactgctttcagtgcataaaataatgcttgcttaaagaataaaaatttttaaatgaaatctttttttttttttttttttttttttttttgagacggagtctcactctgttgccaggctggagtacagtggtgcgatcttggctcactgcaacctccacctcctgggttcaagcgattctcctgcctcagcctcccgagtagctgggactacagccgcgcaccaccatgcccagctaatttttatatttttactagagacgaggtttcaccatattggccaggatagtgtcgatctcttgaccttgtgatccactgccttggcctcccccaaagtgctaggattataggcgtgagccaccgcacctggccctgaaatctacatttttaaactattctaatagacttactgatttgatttgctaatgagttttttcttgatgtggtaaaatgaaaactttctctgttgccacctctttaggatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagaggtaaatgattgttttttgtaaattatataattgtatacttagtaaacactttcatggttttggacaagttgcttatcccctctgggctttaactgcattttctctaaatagagacaaataataccatgtctgtcttaagagttggaacagatgacttttgagatgtcttctaattctaatttaaaaaaaatttttttttgagatggagtctcactctgttgcccaggatggagtgcagtggagcgatctcggctcactacaacctctacctcctggattcaagtgattcttgtgcctcagcctcctgagtagctgggactataggcacgtgccaccacactcagctaatttttgtattttttggtagagatgggatttcaacgtgttggccaggctggtctcgaactcctgacttcaagtgattaacctgcctcagcctaccaaagtgctgggattataggcgtgagccaccacgcccaagcaaaaagaatttttttatagagacaaagtctcattctgtcacccaagttagagcgtagtggtgcaattgttgctcactacagcctcgaactcttgggctcaagcagtcctcctgcctcagcctcctgagtagctagagttacagatacgagccaccacacatgctcctaattctaatatgttaaatgtatggtttatttttagcatttgaaataccatacacaaatacatgtccgatctactagagggcgcaacaaggttggaagaaaaattactggcattgagcctttacctggagaaaataaggtactacagtattcaaaaccatctctctccatactatatgtagattcttgaaagttcttaatatcttggcaaaaaaatgtattctctttgttgtggaataccgcttttcttctagttttgaggtatattagtttgtatgtgtgtaacaccctttttgggttgtagcttagcttgtactaaaagatgatatttttaacttttcatttgatctacttttagatattggtaacctcaaatgactccagaatcagactatatgatttgagagatttgtcactatccatgaagtataagggttacgtcaatagcagcagccagatcaaagcaagtttcaggtaaattggcaatgagatgttcccaaaagagatcaggacatttctcccctagttccatttttccattggtctatgccttatgtttaatggggttcttttcacttttgcaagtagtagtttattatcatgcaatacgtaccttgtccacctatatagtatatagaattcgaattgaccctgttctgcaaatgaagaaaccaagactcagaaaattaagtgattggcctaaagtcatggttgtagagccaagattatgaagactctcatctctagagtttttgcttttgtacctttgtttacgcttttaagagggggcttacggctcatcccgccactcccctccctgccccattgtcttgaaccttttaggaaaggaaggaaccttttaggattctaagaaagcattttaacaccccacagcacagggtcttgtattcaaaactttacatatcattattatttaaatttctaatttgggttctggacactctcctgaaatagggttagctaccttttcttctttctagccctcttcttttgccgttttcttaccagttcttttttcttgaattatacattaattaattcaattggtaaagtattctgctcctgtctttcacaccttaaatcatcattcctcccaacgtggattaactaacatcacagttacttagagctttgatgcaaatacaagtgccaggccactacatcacacgtacacatttagaacatctagagtgagaccatgggtctacatattcaacaagacccttcaagtgttattttaggtatcacaaagtaggaagcactgataaaggaaacctttaaacatatacacacacacattttatttgcttttcctttctccccaaaattcagccatgattttacttacctcgttagtggttcagaagataagtatgtttatatctggagtacctaccatgacctaagcaagtttacttcagtcaggagagatcgtaatgacttctgggaaggtattaaaggtaagtacatacttgcttttgtgtgtcttataagagaatcaagttacagtggatatatactagaagtaaattcatgaccggacacagtggctcacgcctgtaatcccagcactttgggaggcccatacgggtgtatcacgaggtcaggagatcgagaccatcctggctaacacggtgaaactctgtctctactaaaaatacaaaaaaaattagccgggcatagtggcacacgtctgtagtcccagctacttgggaggctgaggcaggagaatcgctggaacctgggaggtggaaattgcagtgagccgagatggcaccactgcactccagtctgggcaatagagtgagattccgtctaaaaaaaagacaaaaaaaaagaagaagtaaattcatttaggcattattttagagaggcagtttgacaatgataaagtgccttgcatttggctttgcttgttttatctatactaaggaagaactttggtctaaaatttgagaagtcagggaatttcagaacttatatgtgattttttttagaaaaatttttgggttttaaatcactcttagttacttctatgttagtttttaaggatatttggcatataacatacactatcgtgtttgtcttggtatccaatttgtcagttatcctgaagtaaattttttccacagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtaaatctttacttgtcctatatttttttctagtcagcacttagtagcctcatttatctcatttgagtataataaggttttcactagtataaagaatatttcttttttcttttttcttaagacagggtcttgctctgtcacccaggctggagcgcagtgacgcagtcacacacagctcactgcagcctcaaccaccctggactcaggtgatccttccacctcagcctcccaagtagctgggactatgggcctacaccaccatgcccagctaatttttgtattttttgtagagatgggatttcaccatgttgcccaggctggtctcaaacttctgggctcaagcaatgcacccacctcagcctcccaaagtgctgggattacaggcatgagccaccaaagaatatttcttgtttgcaacttaatggttgtcagatatccatttctgaacttttcagtaatatatttcctcaaagttttacctgttttaaattcacctgagaattaaaaatgagaaatttgggcctggtgcggtggctcacacctgtaatcccagcactttgggaggccaaggcagatggatcacgaggtcaggagatcgagaccatcctggctaacacggtgaaaccccgtctctactaaaaatacaaaaaattagccgggcatggtggcgggtgcctgtaatcctagctactcgggatgctgaggcaagagaatggtgtgagcccgggaggcagagcttgcagtgagctgagatcgcgccactgcactccagcctgtgtgacagagcaagactccatctcaaaaaaagaaaagagaaatttggatgttcataactatgggtaaccattctctttagagaagtgcaaacaatatatgcaaatgtaaaacttctttattacctgtctctcctactagtctgtaatctctagaagacagagacttttcatgtcttatttattgctgtattgccagtgtctctcacaatgcttgcctacacatagtaggtgcttgatgaacatgtgctgactaaatgaattaaacccaaatgaagcagggctaatttttctacttgccacaagttaacagcttcttgagataggtggctatttacaagtttgtaatttcttgccatttgtagcatatatgctttgagaatgaatattaattccagttatatacaatgctcatattaggaagggagaagaaactgtcagcaagtaatattgagtgccaatcagttatataaaaatctgggccaggtgcggtggctcacgcctgtaatcccagcactttgggagaccaaggcaggcggattatgaggttgagagttcgagaccatcctggccaacatggtgaaaccccgtctctactgaaaaactgcaaaaattagctgggcgtggtagtgcacgcctgcagtcccagctactcaggaggctgaggctggagaatcgcttgaaccagggaggtggaggttgcagtgagccgagatcacgccactgcactccagcctggtgacagagggagactccatctcaaaaaagaaaaaaaaaaaaaaaaaagaccaaggtgagcagattgcttgaggtcaggagttcaagaccagcctggccaacatgttgaaaccctgtctctactaaaaatacaaaaagtggccaggtatggttgcacacctctgtaatcccaggaggctgaggcaggagaagtgcttgaactcgggaaggtggagttttcagtgggctgagattgcaccactgtactccagtctgggtgacacagcaagactctgtctaaaaatatatatatatggcaggcgttgtggtatgtacctgtaatcccgggtatttgggaggctgaggcaggaggtcttgagcccgggcaacatagaagaccagcccgggcaacatagaaggacacccaactcaaaaaatatatatatgattcttttttaatttttaaatcgattgcataatagtttattgactgtattgtctcatgctacagattacaaacaggtcataaagccacaggaatagatacagtgtacaaagagtgcttctaaagtatttgaatggtaaaaagttatcaagtactttaatctcaagtaatttttttgtagtattatttggactatctactccactcatgacacttttccttctgtctgtgaagaaaaattttgataacaaagatgaacttcagtctagcatttctttcagtacaagatacaaaaataaaccaagttagaatgattaaacctttactaaatgcctgtttaactgctgtctgttttctttttctttccttctcagaatcacatccagcttctgtcttctaacttaagtcatttacgttttttctttttttttttaacttatgaatgaatgaatgaatgaatgacatggtgtcgctctgttgccctggctagagtgcagtggtacaatcatagctcactgcaacgttgaactcctgtgctcaagcaatcttcctgcctcagcatcccgagtagctaggactacacgtactaccatgcctggctaattttttttttttttttctttttgctagcaatgagttctcgttatgttgcccaggctggtctcgaacttctagcctcaaaaaggttagtcctactttggccaaagtactgggattacaggcatgagacatcatacctggcctttttttcttttcttttcttttttccccagtgctacctttttacattccatatacttcccctgcatattccacaggaaattctagcttttaaaacaatttgaggaaaagtaaaaagtacagggttttttttaacttctcaaaaatataccacattaacaaggttcagttaactaactgggtccttttttaagaggcacaaattttagtggattgtactcagatttgtgtttgtcattttgtacccatgtaggtgtagtctaagaataagctctcttaaacccaaaatgtgggatcacaaaatatattcaattcccctctctctttgttcctgacgtgtttggcaattcaagcctcaattttccttatgtgtaaaataatgatgataacctagtttatagagtttcaataagaattagatatgacatgtataggctgggcatggtggctcatgcctgtaaccccaacattttgggaggccaaggcaggaggatcacttgagaccaggagtttgagaccagcctggacaacatagcaagaccctgtcttcacaaaaaattaaataattagtcgggcacagtggcgcatgcctgtagggaggctgaggtggaaggatcctttgagcccaggagtatgaggttacaagaaagctatgatggtgccactgcattccagcctgtgcaacagagtgagactctatctaaaatatatatatatatatatatatatatatatatatatatacttgtatgtgtaaaagtgcctagcaaaatgcctggcatgtagtaggcattattgttatcattttcattattattgtgtcttacaaagcattttatatgtatggtgaattattttcttctctatcctttctcatattcctaagttctttgctgctgctactactgcacagcactgctgtgagatatgccaaaagggtggtaaaggaatgttcaaaggcttaggatatgtttttagcacatctaagtgaaaccattttgtgtgactcatcctgtccacaactttccaattaaagtttggattattttcttcttttttaaatctcaaattaaaatctcagttttcacctatgtataatagagttagttaacactgaatttttttattaagtgcttttatgcaactggcaaatgtaagaggtaagcatttatgccattcagcatagttatatagcttttcagtaaggaccatatggcaaaaggtgctgtcagcattcacacagcaaacgtgtgtacttcatttcatggcagtttcagtatgtctgctatacaataaaccttactggcaacctcgctagacacccctgttagcaacagacttgcccagctgatccgattctgccagcactccagtcctggggctgaatgacacactagcttcttgccatgcaatgaagcattagatgacttagatgcctaggctgcctaggaataggtccaagcatccaggccccaagagactgtaatatcctcaagccagggaaagaccagctaagacaaggtaagtgaaagtgagcctcagagcagaggagagattcagcagaatgaaagaattacaggagccagccagaaaaggagactgaaaaggtggggagatgatcttctcccctgaagctggagggtcatgggcatgtgataattgtggcagcaggcttcatattcctttaaaaatcaacttaaaactattttttatacttttaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaa

SEQ ID NO: 5853 - DNA, 47016 bp, human
ctgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtaagtgactgcagctatgacaggaagccgggcatcccaagccccccgcatctcctgtgtcttccccctacacccctcccaggtcccgctgtgtccgccaccgctgttcctccccgtctcactggaggacttcagaacccagacctggggcttcttagggcggggtgactcggagaagggggagtcagccacctcgggcagcctcccggccgtttccctactgaacggtcccagggtcggtctcggagcccgtttctcttctgatccagccttctgtgagggggaacagcttacgtgcctgagtcggagatttgtatctgtggggttctgagcttacctttcaaacatccgttttggcctcggggaccgtagattaaaggagcagtaacaggagaaatgtaacttgtagttttttattctcccgtttaccgctaacttacctattcacttcagaggtggctgtaactctcccctatttgccgtcctctttttcttgcacacagcgaaaaggagcggggggaaggttgggtatttgcttaagaaagtcctctagcgaatgtactctagatcaacagtgttttattaaaataacaccttatcgtgaggtaaaggaaatcgaatacacggtccctattaggcagaatgcggtctaaaaggatggccagacagaagaaatgtgcacaactgactgcagagggacaaacaagtgctgagtaatctggtgattggaaggagagccccagctttgtgttctttatctaattctgcaagatgttttagtggtgattaatatgggtgattctgaataggaagtacagtagttggaatgctcgcttgactaggacttgtatttacttacccacttctccacttttcaaagttggggtagtgctttaaagcgatttcgccgaactcccctacgaatgtacgtggaaatagaggcagtgaaatatattttcatgctgtaagaacttgaggattggtaaaatgtagatgttagtataaaggactaatatggttcgagaagttcactgccttcaattctcacacttactccgtgggagtaataacccgctgtgatgcaagtatagttagccatgcatgctagaagtcattctaaaaactaatgtatgtttatacacaatatgcaccaaaaagttacagtaataaaatcagaaagcaatgtacgttggtagatttcagatgtttgtctttccaccaaccttcatgtcactgttgtgggattttggggtggcagtggccaatcttgagatgacaccgaatctccttcaagttcaatatctgagacaagtttagagctaggtgtagagcataggaaatacatttgggttttgaaatgtattggacttccgtgaaacttaatttttgtgtgtgtggttttcccttcaaagtaatgaactgacaattcagattgaatgagacaccaagtcctttggtacttttgtgtgtgtgtattggggtgggggagggaaatcatcagtttatgagctgatcagtttagaactactctgtggatattgttctttccactgaataagtttaatttcaaaggacgcaagttatatcaggacctgtgtaaactgtctagtccagtacctgggcacagagaaagcattcaaaatgttcatgcttttctccttcctttcttggcattggcaaatttgttaactttacacaaagcttattttgggagatatatagaacttggacctattttacttatctaaaccggatgagtcattttgatagaattgatagagtcacttcttccctcatgagataatacagcttctcaagcactttgatcctctgatattaggtgaaaactgaaaaaggtttttttggaactcagctttctaattttaactttaacctgcccaattactaagtgtgttgagttctatggataaaactacagggtcagtttgtggatttcagggctcctttctgtattagaggattggaaagacaatagactaatctggagaattgcatctgaaaagaactggcagcactgagggcagaaaaaggttagcatcatttacattttcctctatcctttgtggaaggttgtatcatttgcataagacaccgtgaggagatctgggtgggcaacttataacctagaaatgtagtgagaaatcttgatttgtggaaacagattgccttactagatattggtcatcagaaatatgttctgttccttcatatgatctggagtggcaaactatacaatttctaaggttaatagactgaatttgggcacttcagaaatgttccttgctgttgtgtgtttgggagtacacagactatgtcaacaaattgtagtaaactgaataggcagtggagacttatctcatgttttgttaattagcacaatcctaatacacaagctatttcctaaaattaatttatttcttgcattttccttccaatgatgtcttcggctttgttaatctactctttgaaagcaaatttaataagttaaaaatcagcccagtttttttagagacttttaattccagtacagcctacttttctacagtggcagatgatcttcacttgcccagctttgcaatatatgccgtatttataatgcttttttattgatattttaggtcaggttttctttattttcttttttcttttctttttttttttttccaagatagggtctcactctgttgcccaggctggagaggtggtgagatcatggctcactgcagcatcaaactcctaagctcaagttatcttcccacaggtgcataccaccctgctcagctaaaggtttttttagagatggggtcttgctatgttgcccaggctggtctcaaactcctggcttcaagtgatcctcccacctcagtctcccagggcgctgggattactgtcaggcatgagccatctcgccaggcccaggttttctcatttttatcttcatttttacatatgaggaacatttttttttttttttgagatggagtctcgctctgtcgcccaggctggagtgcagtggcacgatctctgctcactgcaaccttcgcctcccgggttcaagagagtctcctgcctcagcctcctgagtagctgggactacaggtgtgcgccaccacgcccagctaatttttaggagagacggggtttcaccatgttcgtcaggctggtcttgaactcctaacctcatggtccgcccgcctcggcctcccacagtgctgggattacaggcgtgagccaccgcacctggcctaggaaccttagactcagagacggttaagtgaatttgtcctaggagagagcttttaagtggcagaactgggatttgaaaccagctcttcagactcctagtccagtatttttttttttttttcctgtggagggcgatgagagcagtgacagagaggtggacagagatcctcccctggtaaattctggagtaaaatgctttaggaccaagttgctgaattgaactgatacatctccattaaaaccagcagcctaaacttttttgttctcttggcaagaaattccactttctttcagcaacgtgtatttttgttttgtcagataggaattttgcaagatcatagcctgttgcagctagaagggacatctagttaaactccttcgtgtaaaatgttgtgaaaactgaaacctagagagagaaagcaacttgtaaaagctgccacagcaaattaatggtggagctaggtctagaacccggatcagtttgactgtctggcgttctttctgctactgggctgtcttttgatagagcaggaaagagaagaggaatcgtgtggtacactagaaaagagccctgcactgtgagtcattttatttcctcatctttaaattgaggggattacactcttgagaacccttccaactctaaatgtctttatattgaggtttaatagtgtgcttgtattgataagcttttgttcttggtaaatctttcgtgattttttttaatcttttcgtttaacttaatggtatttggtacatagttcaagacccataaatttgaaattaagtatttactgggtaaattatatatgagatgaatgcccctgctaactcatgtggtttatacttacacatactaaaggctggcactgagaacatgttgtaaaaataaatgtaacattttcagcactcttttttttagtggcagccaaaatatttttgaggccttggaagaaggatagaatcataacatttttagagtaggaagggactggagatcattttagcccagccttcccttttaactgaaagtgaaatttagggtctgagaggggaagtgacacattgctaataagggcagacttggaactagagcccaggtctcttgattcctcacttataccatgctaccatgtctgcggaagaagggaaagtattgctggctattcctgccataggtttctggcacttaccctattagctgggcttttaagatggtttacttgactgtttcttcataccttgcctatcagaggtcttgaactattttagaatcctaagttttgcttacgagttttttccaagtgaaagtgaaaaacaatggcaaaatagcttgtctaagaacagtgattatttgtattattttattcttaggcatttagttagtattaactgcaatctaccatattcagataggaataatgataaaatcttaagtcatgggaactgagaccaaactgtcctgaataattgttaggtctgaaaaacaaaaaggtgtgtagctgcctttgttgaaaactcagcttctcactttacttaggtgtcagaaacatttctctctgaattgaaaattgatacaagttttaatttaaaaaatacctgtgcaatatttattactttagggaagtttccttaaaaatggctgtttgttgatgagttgacatttgatcacaaatttgattactgaaggctttaaggagtgatagaagtatatttacaaatgctgttttatcgcactcatgtaacatcatattgaagtgagaaaaaacaaccctctacatattagttagtaaattcaagttctaaatttagtgacatccggccgggcaccatgactcacgcctgtaatctcagcagtttgggaggctgaggcgggtggatcacctgaggtcaggagttcgagaccagcctggccaacgtggtcaaaccccatctctactaaaaatacaaaaattagccgagcatggtagcacacacccagctacttgggaggctgaggcaggagaatcgcttgaacccgggaggcggaggttacagtgagctgtggtcatgccactgcactccagcctgggcaacagagcaagactccgtctcaaaaataaataaataaacaatttatatttagtgacatctgactgtcagttggtaactcatgggggtaggatagtccatagtggcatggcaatttgggggctcaagttgaatctgtataaactcctgtaaattggaaactgtattctcttcttgtgataatctacttcataagataggacagataaaatttgtgttgtttgttttttgttttttgtttttttttttgagacagggtctcactctgtcacccaggctagagtgcaatggtgcaatctcagctcactgcagcctcgacctccccaggctcaggtgatcctcccacctcagcctcccaagtagctgggaccacatatgtgcaccaccacgcccagctaatttatatatatatatatatatatatatatatatatatttttttttttttttttttttgtagagatggggtttcaccatgttgcccaggctagtctcaaactcctgggctcaactgatccacccaacctcgacctcccaaagtgctgagattacaggtatgcaccactgcacctgtcccttgattttaaaaaatattaaaaacctaaatagttttaggatgtgaagtatagtggtggtcttaaacagaaaataatttctaattattggtattttagacttactgtctaacctttacattacccaacactccatgtgtttgtactcttaagttcattgttaagactttgacagaatcaggtgaatttgccaggcaagcacctttaagaggctgcttgtttcctcctcatactctgcaattttgttagttacttcctggggtagtagtggaggtggaggaagggagtataaagagatcatgcaggttgtggtgatggaggtggaagaggtaaaggtagccccagcagtaggtatagagaccaagttacagtgctgcttcctggggcatggataactgagataagacaaatcccatcattttgatacacatgttcacagcatgaattaaataaccccttctctaagagattaataacctataagaaatacctcaaatcaaagttaaagtaacaaaaattgtaggtactttatgatgtcctactgatatttagcttgaattgataaataacctatgtttctcatttctatccatagttaggctaatatctacaaactttcacaaggactgttcccctctcactgttggatattattcagctaaccagctaaacctttaatagggtgctttccttactcttcagagtgaaactctttctattcccttatttcaaactcagcagtgtttgtgttagtctgtcatctcatgattcaaaaccgaggaaaaagcacctacgacataatgtgggcctcatacctgatggcaaccctgatgtttttcctcagtcagtatacaaatttatcttggttactatagcaaccagtctatcagttattcttctagctcttttgccttctctcagatactaggattaccatataatcaggttctgccagagcgcttcaggtcttagagttctattaccagctgcaactgtctggcagttcacagtttggcattccatcagagtcagttgttttttaagtccacaaaacctttttgtctccaaacctttttaaacattttaaacatatataatttaacaaaaacatgtttaggcagcaatttcctcatactaattttctcaatccagtgttagtcattgccctgaagattgaatgcattgcatcactgcatccaatagccatccctttataataacaagtagaatcaatttccagatcgagggtgaccatttaggaaatatatttgcaaatgtgattttagactcagtatcatcacaaactagctaaaatgacttaaaagcatcttgatcatcagcagctaccaaataatccagcttttaacaaaaatgatttctataggttgtagaaagaatgtttggcctttagattaattcattttaatttgagaaaactgtttagaaaactaataggaagtgttatcttttgtagcccttgaataaacaggaagagaacagtaaagactgaatagttgtatgggtctttttttttatatttatttgacatacttttttaactcttaaaaatctcagaattcatgtaactaaaatagttttaaattataaatatgtttacctgttttggtcaaaacaaggattggccaggtacagaagctcatgcctgtaatcccagtgccatgagaggctgaggtggagggatcacttgaagccaggagtttgagaccagcctgggcaatgtagcaagacctcatctctacaaaaagtttttaaaaattagttggacatgatggtgcatgcctatagttctagctatttgggagattggggcaggaggattgcttgggcccaggaggtcgagggtgcagtgagctatggtcacgccactgtactctggcctgggcgatggagccagactctgtctcttaaaaaaaaaaaaaaactatagttaaattatgataatgcttcaaggaaatctttaattgtacaaatagacttaagactggtttcactttctccacagagtcctgatctttaaaatttttcaaagggggagtcaggtttttaaaaaatctgaggatgaaatataagattttttgaaacttctgagggaaaacttgaatggtatttttttttattatactttaagttctggggtacatgtgcagaacatgcagttttgttacataggtatacactgaatggtattttctaataggtatcctatacagaacaagccatacctgtaacaagctatctatatctgtataaaacctacttggccactactaattgtaatagactattccagtacaaaactcattgaaccatgggcattcttatgaaccacagatcaaactttctagagaacctataaatagtatgtagtgctgtatgcaaactcactgtcccaggagcaagcatcctgattactaagcaagctcaagagaagaggtgggagtattctttctgacattgttcttgaactggtaagaatagctgtggatgaacttaatatccatagtcctcttttaattctgtgcctgaaagtatttattgaaattggaagactaagggaatcatctttctggttattagcagtactgttaacaattgaattttttttttaaatctgtcttttaaaatatattacctatccatgccaaactaaaatggcaggtggattgaacatttcactcagccccaactccacccctttcactgccagctttttctttcctagcatagtcaatgtcattagtacagagatttcctagtataactacttcttgtcccttaaaactgagaagggtcagtgatggaagaaatataaagggtgggaacttttggaaggagtaagggaaaaattggttgcattggatatggtggacaagttggtaaagactttagtgttacaggtggtgcttagtcattggattagtgaaagatgggtgagcagaatgaacaagtagcttgataaaactagtagctttgtgagtgaaagcaagtagatttgtctgtattttgcaatgggtattttatctttattagcttggcttaagggttaaggttaatgattgagatcagtcctttttcctttaagtgcaccttactgtgcctattatgtcccagatcatagcccttagctgttgacttttaacctttgccttatttcccagcatagtccacagttatgtctagcagtgcacacaaggtttagttggggaggcgggtggtgagtaagcatgctctgtggtatctactgcgcttcacaattggttctgattttgaacttcctggttctctccaatctccagtcacccttaaacacacacaggtaccagttcctataagaggaggtaggtaagggagctgaggcaaagagagtgctttggatgtataggatcttcataacttgaggacatcctatacccagtaaatattaaatgttaacagtaaaaccttgggtggtgttgccagttatcctgcattcctatcagttccttgttaccaacttttttttcaggaatgaatgtgttcacagtaagaaagaaatattatagtgctacatgttacatgcaaagaacgataacaccataacaccataatgctaactaacggtgggcatttgttttcaaagttcttttaaaaagttactgtttcaaacaatgaaaagcagtatttttatgcccttcattttaagctttgacataattgattacggcatggtagccaggtcagaaaatgaccttgcttctgaaaaagctggaatcccagacactgttcactgcatttcaaagagttatggtctttgttcctaagggaaaccccctcaggatatgagccattgctgatttgggtttcagtgccgtgtcaaaaagtcttaatcccagatttttttttttcctacaattgttttatagattgttgtcagttgcttagttaggccacagtactgtattgtgttttgtttttattttagtataactgattcatttttttggccacaagcctctaactagaaacacaatgtttctttttctctttcccttcaaatgtgttttgtagcagtcacagagagtgactgctttgtcactctttgtgactacctacctaatcaaacctctattggctttcaaactaatgggaaaaatgtattcctaatagctgggtaattacaaaaaaattaaatgattagtaattactgtttaagatgtaaataagattgaacaatttgtaataatagtaaagggcttaaacttgatctacatagtgtgttctgtaggtaagcattctagataattgaagatttttgtagaatatatatatcaagtcattgatatatatttctttcttttttttttttttttgagacagagtcttgttctgtcaccaggctggagtgcagtggcacaatctcggcttactgcaacctccacctcccgggttcaagcgattctcttgcctcagcctccggagtagctggcatgccaccaagcccagctaatttttgtatttttagtagagatggggtttcaccatgttggccgggatggtctcaatctcttgacctcgtgatcctcccacctcggcctctcaaagtgctgggattacaggcatgagccactgtacctggcctgatatatatttcattagaaaaagaatgtagaagtagaaattcaagtacataaagcatagaaattaaatttagaaaataaagtacttaatggcagattttactgaaatatatttgagtttttgttattcatgatattgtaggaaaacatgaataattaaaagctgtcagttacacaacaatctcaggtcagtcattagtttaccatcaaaacttttatcaaagataataacagtaggttttctttaattttaaaaaataaatagtttggtttgagttttgttcctctgctcatctttggtgatgagcagtgaactcaaaagaaggaaaacaagaaatcttgaagtctgagtagttcactaatagaatttatcaatttaaatttttaaaaaggggggctcacgacaggtgctttagaatgctagtttttatttagaagttactggcatttacttttaaaaattagtaccccaccaggtgtggtggctcatgcctgtaatcccagctacccaggaggttgaagcaggaagaccctttgaggccaggtacttgagaccacgctggccaacatagtgaaaccctgtctctaacattttttttttaaacttaaccaggcatggtggtacttgcctgtagtcccagctaggtgggcgtagagggggattactggagcccaagaattcaaggctatagtgagccataatcacaccactgcattccagcctgggcaacagagtgagaccccgactcttaaaacacacacagctgggcgcggtggctcatgcctgtaatcccagcactttgggaggccgaggcgggcagatcatgaggtcaggagatcaagaccatcctggccaacatggtgaaacctcatctctactaaagatacaaaaaattagctgggcatggtggtacacgcctgtagtcacaaactagctaaaaatgacttaaaagcatcttgatcagcaacagctaccaaataacccagcttttaacaaaaatgatttctataggttgtagaaagaatgtttggcctttagattaattcattttaatttgagaaaactgtttagaaaactaataggaagtgttatctttcttttgtagcccttgaataaacaggaagagaacagtaaagactggatagttgtatgggtctttatttttaaaaagccatatgtctttctttttttatatttatttgacaaacttttttaactcttaaaaacttcagaattcatataactaaaatagttttaaattttaaatatgtttacctgttttgctcaaagtaaggattggccaggtacagaagctcatgcccagtgccatgagaggctgaggtggacggatcacttgaagccaggagtttgagaccagcctgggcaatgtagcaagacctcatctctacaaaaagtttttaaaaattatctgggcatgatggcacatgcctgtagtcctagctatttgggaggctgaggcaggggaatcgcttgaacccaggaggtggagattgcagtgagccgagatcgcaccactgcactccagcctggcgacagagcgagactccgtctaaaacaaacaaaaaagaaaaaaccaccaccacacacagattagtactccatttaatgttttaggtaacttacaaaaccatattaatatggccaggcatggtgtatcacacctgtaatcccagcactttgggaggccgaggcaggtggatcgcttgaggtcaggagttccagatcagcctggccaacatggtgaaactccatctctactaaaaatacagaaagttagccgggcatggtagcacacaggagctcctccagctactcggtagactgatgcaggagaatcccttgaacccgggaaacagaggttgcagtgagccaagatcacaccactgcactccagcctgggcgacagagtgagactccatctcaaaaccaaaaaaaaaatcttagcactttagcttgataaagcttctgtaatacggcctgtagcccaacatcttgtttactttttcaaaagtaacagtgatctagcatgattgcattagatattgatttctctaggcaggcataaatttagttatctgtttctgtcttgattttactggaaattactttaagtcattaatagatttgacttttattctaacctactttaacaaattgggacatggtgatatagctgccttaccttggtgttattgttttactgcaggtatttattgaatggttgtgaatgtgcagaatagaatgtttttagtttggaatccttgagtaggcccaggaaagtggttttctgtttatgtcagtaaatacattatcaagctgttcttttaggaatatggcataaagctgcactacatacatcatttttgaaaaatcaggttgtcattttagataagatataattgtaagaaggtccacttgaagttttgtaattaccctgtatgtgaacagatgtatatttcacaacaaagtttcctttgatttcattaaagatcatttacaaatattgccacaaaacctttcaaaaaacatagggccattgtgccaaattttctcactatttctattaatatcattgataaaataattattagttaattttagatgtaatctgctatgctttcatagtatttaaaatttaaatgtcctttcaaaaggtaataaaagtaataattcacatcttgaagattcagttaatatcctattggataattgtcataactattctcagctttttgtgaatgttgttaataaaccagtattgctttgcatccaaggaaattcgagtgatttctattttctgctgcctagttacctgagattttgggatgtactaggaaaatcagactaatttatgattgcctagcacttatttttttcctgctgtttttagacttttcaggtttagttggtattatcacttttggtagtagtcaacttaaaattattagtagtcaacttaaaataggactgtgagaatgagagtggtactgttacaaattatttaggtttgaaaggccagcagatgatttttctcttagatgccatttcttcaatttgagtagcactgtctttaggttgaaggtgcttatatacatttcaactccagtgtacagtattacataccacattttaaaagctgtgcacttaaagcaagatttaagaacaaaggagaacagtctcttgttctctaaacttgaagtgtttttaatttttggttcaacctagggttagttttgtttgtttttatttttgttttttgcttcattttttgttgtcatcatttttctgcctggcctcagtgggcccaagaaagagttcttgttaagtgtttcctgaggaccagacacgtgattccctgtttagacttagcacttcagtgtcggtcttagtttgctatcaaatcttactgtttcaacttgctggactttagaaatcaaaactctttaattagttgcttactttaatgactggctaagtccttatctatgctcataccctgttcacctcaaggaccttagaatcctagcgccttctttgtacaggcaagctattctttgctttgcttgattcagttccttggtgcactgcttaagctcatcttacttttatattttctttataacaaaggatagagggggataaaaacaaaatcaagctgtagggtaatttcctggtgaaccttttgtagtcactttcatgtaagaaaaatgtttcccaagcaaccagctttattctagctgactcactttgtactccctccttccatgtcattgctcctttttacctctttaggagtctgttaggaattttgcaacctgacaaaaggcttctgcagagccaaccacctttttttttcctcagggcctgaaaaaaaagtgagtcttcctactgacaggaaaataaaaagagaccttgttagtcaatttttttctgtatgttcaattgttctggtatattcttttccttgagtataaagaaaagtctgaaaataatggtaaaagtgtgagattgctctgatatttcctttttgtactttaggaggtggttctttgagttcctagttgtttagttgaacatgaagcaggtggcaaatgtaagtttagtctacacactgattccttcctgttcgcagaagggttcatgtgttcgtttttaaataatcttcgggtaaggaatagagaaacaccaagcccaagaggcagaaggatctgtctatagctaatgagtgagaaactaactgtgggatggtttatggtctctggctctttgaaaccacagaaatttaaagttatttttaaaaagccaacttgactgggcacagtggctcatgcctgtaatcccgaggcaggcggggggccaaggcagacagatttcttgagcccaagagttcaagaacagcctgggcaatatggtgaaaccccatcttctcaaaaaaattaaaaaattaaaaaaaaattagccatatgtggtggtgcatgcctgtagtcccagctactctggaggctaaggtgggaggatcacttgagcctgagaggcgaaggttgcaatgacctgagatcatgccacactgcactacagtctgggaaacagagaccttgtctcaaaaaaaaataataactacacctaagcacttacaccattattttaagtcctgattactttaaggccataccacatgagtgctgaagatctgagtttaaaattggaaaaggtgttcctataattgcctggagaaaaaccaataattgcccagagaaaaaccacttgcagaagctatgaaaaaccaagttagattcctactagtcagccacgtcagtagctgatttcaaaatatgagttttgcagtaagccaggcaagacagtacaagtagcttctatttggggaatctaatctatataggttcttaatacatacttgcattgattgccattcaaatctaggagctattagtgcttcagctgtgggaaaattgtgagattatgcattgacagaattgagaagcaaattctacttcacgttgcagaaggctcatcagattttagattgatatagaaataatataacgaatatttctactacgctttttgtaaagtgaggagactgttctaaagtgactttgtatatgtaataactgaatccctttttaatgacaaaataattttaattgatatttatctagaaagttggttgttgatggttatttgacctatacaggttaacctcattttgaacatgttgactgaggacagtttcagtgattataagtcaaatcacatatctagagattttgtcaatgtattacagtagccatcttggttttgtggggcaatctaagccaaaaaataatgaagctgtttatataccttcctgctttttgctgagcatttttgataaatgtacataataccatacatgtagtatttgcatttaagcctattcagtgcatgcactgtctggaagagctctgactaaatagacacgtgcaaattttttccccattcagtgaacactattaaaaaatcagatgaatatttatacagtggcattggccatgcaattcttcctgctttgtccctttatcacacactaacagaacgtaggattaattatccacctaattaacttgggggtggggtagagttgctggataaagtacaagacactcagttcaattccaatttcagataaacatactaaaaatgtattcattgtttatctgaaattggaattgaactgggcatcctttatttttagttgctaaatctggcaaccctaggtggggaagaggcaggagactagtagatataggcacagttgtgagatttaaatacaccatgcaatgacaagagtaacctttactctcacgggaatactaagtgttttttagcgcaatgctatttattttagtgtccaatgcttttttctttttttttgaaaatgcatcaatgctcaaagctcaaaaatagtaaaacgtggctcacacttataatcccagcactttgggaggcagagaggcaggcagatcacctgaggtcaggagttcaagaccagtctggtcaacatggtgaaaccctgtctctactaaaaaaaaatacaaaagttagccgggcgtggtggcaggcacttgcaatcccagctacttcggaggctgaggcaggagaattgcttgaaccgggaggtggaggttgcagtgagccaagatcgtgccgttgtactccagcctgggagataagagtgaaactccgtctcaaaaaaaaaaaaaaaaagggagaaaaaagaaaaaaatagaaaaatgtaacaacatattgtttagggatacatgcacgtatgatgaactgtttttgaaaacaaaaaattaagggaacaataagcgaaatctgggatagtggttacctctaagggagcagcaagcagatggaataaagcacatagtagctgcactggtattaatgctaattctcagttaatgtggtaagtgacaggatgtatttttttatgcttcataattacgtgtacacattgcacatatcaaatacagaatagcattttaaaagataagttaaaacagacttcaataagaaaattagcctatgtgcaaaatttaactgtatatactttctaaaataaatccaaaatccaaaaagtaaggtcaaaaggcattctgaaattttaccagtttgctaaagatcatattgagtaattaatagattctagaatgattacttatctgctgtaatacatctaaaataattaaactctttggtttgtgaaaatttcatttttattacttgatgtctacagtggtgaatcttcagtttttgtctttacttggaaagattactgattgttcagatatattatatgccaaattaaaggaaagaaaaacagcaggtagagcatgcattaagtgattaattcaaatgagctaggcctaaactttaggattcctggaacaaaaaatcagaaatctctgttttccttgattaatttttaaaagttagatttctaactcctcgtttgtaaaaactattatgacagtctacaatatccatcagtaagcagaaaaattcatctttagcaagtgccagtttagagcattaagctgaagttagtgtttagtgtaaatttatttagtgttttaaagcacttctagctctctgtagtcttatataattttgtcttgtagaaatagctggagggtctattccagaaagcctatccaaatatgtcctcttctcccacttacatacacacttaggtgcccctcctctgtgcttcaaggttatcatgtgcttgtgtctctcattgcaattgttaccttatattgaaattatgtgttatattttcctcagcttatcagattgtgacctttctgtgggcaagggctggatctttctcaccctttgtatttcaatgcctgaaagtgcctggcacatggtagataaccaataaggatttgttgactgaatgaaggggcctaaagactcaactaatacagctccttcattttacaggtgtggaaactgaggtttaaagagattgtggctttagaaatagaaacaagaccacagagattgtctgttccagccttctacaatatccctattgagacatcattgagtttctgttttaatactttatcagggaagcagctcatggctttttctaaactcaggttgttactgagattgttaggttgaacaaaagcctatctctttgtaatttctactcttagtcctagttctgctgcataatgcttcaaacatttgaaaacaactacttttcttccttatcttcttctggttagccatccttagttctttatatcattccactcagtttctagaacattcaccaaattgatttctctcttctgagtatgttctgtttcatcagtgttccttttaaaatgaatctcaaaaagtatatgatgttcctaaatgtgcttttatcagtaagaagtagaagagaacttaccattccccttgctctggacatgatagttctgataattcagcctaaaaacacagtagttttggcagccatatcacagtctttgtctgagcaatcaaccaaaatacctaaatgttttcacatgatttgctgttaagccatgtctctcccatcgtgcattttacatttatccctactacatttcataccgttaagatttgacccattgttctagcccattgaaatattttggtggccagtggcagtggctcacacctgtaatcccagcactttgggaggctgaggcagaaagattgcttgagcctgggaggtcgaggctgcagtgaaccatgatcgtgccactgcactccagcctaagcagcagagcaagaccctgtctccaaaaaaaaaagaaaaaagaaaaaagaaaaattttggggtcctgtcagccagtatattacctgtctctctcaactttgtgttatctgcaaatttagtagatatgccatcagtatccttatccaagatattagtaagaacatcaggtagggtagaaagtaatttagtgcttaaaaccggatttttgtgtgtgtgcaatattctcttttattctaggccagtaaccctatcagaagaggaaattaggttaatcttgcatgattggcttctgtgaatgcttgctgactcttaatgagtatctttttcccttgcatagggctcttaaacaattaaacagtgtttaagaaatttgtttggaattgacatcaaatcaatctgtctgtagttggtggcatctaggcatctacctgctttgcagagttgactattagtgttttctttacatcatccccttccattcccctgattcttcaaaggttttagatggaaattgagctctgcaaattctcagatacactgggacataatttgggagagtagaatggaagtcacttataatattaatagttaggtacttttatctccttgaatgctttgggattcagtttcctcattctacaatttgtttttccctttctggtttgactatcagtaatcttaatagaaaaaaaagttgagatagccttttacattataataacgtatacttatccatatataagtagacctgcactttatatttgttgtgcttgttctgagtataaattaagaaaaatcttgtctccggtattttttttaaatcttagcacattctgagtgccagcctttctgataatgttcttacaggtttttgcaatttttcttggatatgtgcccattccatccctccaatctctcctgcatgtttttaaaaaaatatttcttctgacatgtcaccatgaagatgcaatcaacaaaattcagacatgagaaattctacaggatgagcaacctactttcttcaacacatgaattgcaagaaataagagagattgaaggggaacctgctgatttatcgaaagagacatatcaactgattgtaatatatggaccgtatttgattgatataaaccaaacgtacaaaaatttgggcagtctgggaagtctgaatgttatataacagcatgttatatataatatatataatctattaatgtatataataaggaattgttaaattttatagtagtgttgtggttatgttttaaagagaaatctttgtcctttttagatgcatactgaaatatttatggttaaaaatgaaatggtttcggccgggcgcagtggctcacgcctgtaatcccagcactttgggagaccgaggcgggcagatgacgaggtcaggagatggagaccacggtgaaaccccgtctctactaaaaatgcaaaaaaattagctgggcgcagtggcgggcgcccgtagtcccagctactcaggaggctgaggcaggagaatggcgtgaacctggaaggcggagcttgcggtaagccgagatcacgccactgcaccccagcctgggcaacagagcaagactccgtctcaaaaaaaaaaaaaaatgaaatggtttctgggatttgcttcaaaataatctggcagaggggtggaagaggagtactgatatttttatcattgttgaacatgatcaacatgttgtatatttgggtttataatattattctcccaattttgtatatatttgaaatagccataagtaaatgttggaaaaactccccctaaatatttattgtcacatagatttttactggcagatttgggactaaaactcaggtctcctgattctgctctttttttgtgtgtgtgtagctaaaattatagctcttgtactttcagattgatgtcatgttgtcctttcagtctctgggacccccaagctttccctgagaaatttgtggtagtacttgtagataaattaaggccttactaaagggtcacagtttcacttgactggctacctacctatgtgaaaccataagggacattagacttactagtgtagagaggctgcatgggttattagaaccagcaaagaaacttgggtcctagtcttcactaggccttagcataagttctaagatggcagggaccatgtctgttttgttcactactttatactcaatacctgggaccatgccaggtacatggaaacaatcagtaaatgttgaattaatggattaatttaaccgatggcataatttccctcacatgtaaaatgagacagttgatctaaatgattcttaagtttccttcaaacactgaaaaaaaaagtactcttgccttctgactgatttttttaaaatccttttaggattttgaaaaggattactgtaaatttctttaacactaggtgacatcagtaggtaatatgctcactttgaataactgttatagaaaaaccacagttgctatattgcatcaaaatctctttaaaaatagactactgttatatattttctgttagattggtatttatttctataaagtacatgcatactgttctcaacatactaaattagagagtcaggtttagcaagttccaaagtgtagccatctaagaaggttactaaaatgttccctttgcttgcatacttgtgctttttgcttcagttgtattgaatgcagtactattatgtcagagtttataaaggatttgacattttgcttcccaaggaaaaatcagtgggcaacttttggttaagtggcagttattgtcatcgcatcagtgactaggctcctatcattgggagtaatgaccttattatgaaattttgcttcaggtatctgtaggttatcgctgaatcaggtcagagtttgtaaaagaaaactaattcctataccgttttataaaatcaccagaacagtgttttgaagccacatacatgttttgaaatagtgactatatatatatatatatatatacttcttgaggacctttccgcattcctccagctccttctgaagccttgtcttggctgatacatggatgttgatgacctctcttgttgcttctcccagcagtgtttaccaagggcctttgggaaaggtttgcatgacatcacagggcagctagaggggagaagtgttgggagactggaaaggcctctgtgtgatgccactaatcatatgaagtagcaatccacatactcttccttttttttttttttttttttttggagacagaatcttgctctgtcacccaggctggagtgcagcggtggatctcggctcactgcaacctctgcctcccgggttcaagcgacactcctgcctcaccctcctgagtagctgggactacgggtgtgcaccaccacacctggctaattttttttttctttttgtatttttagtagagatgggatttcgccacattggccaggctggtctcaaactcctgacctcagacaatccacccaccttggcctcccaaagtgctgggattacaggcatgagccaccatgcctggccaaaaataatttctataattaaaatgctaaatgaatagggactggagaaagcatgtaataaactattttatattcagacatgagctttgttaatataaactaaatgttagctagtgtactagtgtatgaaaataactttcttttttattttattttattttttgagacagagtctcactctttcacccaggcgggagtgcagtggccctatctcggctcactgcaagctccgcctcccgggttcacgccattctcctgcctcagcctcccgactagctgggactataggcacccgccaccatgcccggctaattttttgtgtttttggtagagacggggtttcactgtgttagccagggtggtctcgatctcctgacctcgtgatccgcccgcctcggcctcccaaagtgctgggattacaggtgtgagccaccacgcccggcctttttttttttttttttgaaatggagtcttgctctgtcacccaggctggagtgcagtggcgggatctcggctcactgcaagctccgcctcccaggttcacgccattctcctgctcagcctcccgagtagctggggctacaggcgcccaccaccacgcctgactaattttttgtatttttagtagagatggggtttcaccgtgttagccaggatggtctcaatctcctgaccttgtgatctgcccgcctcggccaccaaagtgctgggattacaggtgtgggctaccacgtccagccgaaaataactttctaatagaaaacaggatataatgcattaaaatgttctatttatattgaaagttgctgaagtactaatcttaaaattgcctttatattcaaaacctaagtggaagacacactaaataattttagtatttgatctgtaagccatgtgggttttttagtagaatatcagtacttatttgaatcagaatttattttgaagctgtttcagacgttgctttttgtgtttaaattcattggcagcattgatagacactgtcttcaatttcagaaactatgctgcaaaatcaaaattttgctgtttttgacattagtctaggcaatgatattttggatttaaccccaaaagcacaggcaacaaaagcaaaaatacacaaatgagattgtgtcagactaaaattggtctgataaaattgcacagcaaaggaaacaacagtgaaaagacaacctacagattgggagaaaatatttgcaaaacatatggtttagatgttttgtgccctccaattcttatgttgaaatgtgaccttcagtattggaggtaggcctagtgggaggtgtttcagtcatggggcagatccctcatgaatgtcttggtgctgtcctcacgatgaatgacttcttggcctgagttcacgcaagatctggttgtttaaaagtgggtggcatctcctcccccactttcttcctgtcttgctatgtgatgcatcccttttgcattccatgattggaagcttcctgaggccctcaccgggagcagatgctggtaccattcttcttgtacagcctgcaaaaccatgagctaaaataataaacctcttttttttttttagacagagtctcgctctgtcgccaggctggagtgcagtggcgcaatgtcggctcactaaaacctccaatttcctggtttaaggaattctcctgccttagcctccctgagtagctgggattacaggcacgcagcagcacaccagctaatttttgtatttttagtagagatgagttttcaccatattggccaggatggtcttgatctcctgacctcgtgatccacccgccccatcctcccaaagtgctgggattacaggcatgagccaccgtgcccagcctaaacctctttttttttttttaataaattactcagccttaggtatttctttatagcaatgcaaatggactaacacaccatacatctgataagggattaatacccacagtatgtaaggaattcaaacaactcagtagccagaaaacaacccaatttaaaaatgggcagaggacctgaacagacatttctgaaaggaagacatacagacagatggccaacacacagtggaacactattgagccttaagaatggaatcatgtcatatgtggcaatatggataaacctagaagacattatgttaagtgaaataaaccaggcataggaagactactactgtataatctcacttgtatgtggaatgtaaaaatgatgaactcgtagaagcagagagtagaatggtagtttccgggggttgggggagtagggagcagctgaggaatgggaaaatattagtcagagggtacaaagttttagttaggaggaataagttctggagaactattgcacagcatgatgactataataataacaatgtatgtttcaaaattgctgagagagtaaattttgaatgttctcaccacaaaagatcagtatgtaaagtgaagaatatattaatttgcttgatttaaagatttaccatatttgtaattagtattaatatgttggaagtttgagttttgttttgtttctgctgttaggtgagcaaggaagcctagctcttgaaatttgtatttttgttcaactttgtaagaagcatatttattatttaaataaatatttattgatcagatagtaaatgcatcagaaatatttgatttaaaggtgccctatgatgaaagctttggaaagaaaaaatgaacttttgaagctctcattttggtttgtcgggttttctttaaaaacataccaccaatactcaaatatgtctacatgtaacttcagagttttctgaaaaattttccgtgtgtgtggtttaataaagttattttatgtagacatttgaactttttctgcaaaaaattaccttaatatgtaaaaaggataaatccaatttaccccatttagtatctatagaatattttgaagaaatatttttctatttttctttttttatttcttttttttttttttagctcctgctatcactggagaaaaaaatatttttctagttaactagatgtagcaaagtattattggacatttctgggtatgtacgtgtatgtctgattatatccgtgttttatataatatatttcaaatttaagggaaattagaggatataatatttagatcattaatcatggtacaaattatgtctccactctcaaactaatggtcttaagacaaaattccctaaaattataggaactctaaaatcccttgcttaagatatttctgctagttagtgggagagctaagagtagaacttaattttcttgacatctagttccccatttctccctcccatccccaaacttgaacatgaatagttgttttctttaggcacataaacactgaaatagtctactgttactatctctactttgacattagagacttatttacagagaatttttgagttgtctaaggatactgaagattaataacacctcacttatctgttggccacctctgtggtaatgacagttctcaagatacagctgaaaacaagaaataagcatttaaaaagcctctgaacagttcaataaaaaaaaaagtgccacaaagttcaaaataagattatgtacgtaaagtctcatggggagacccttaggatccctagattctcccttcaccatacaatttcatattaaggaaatctggtttcccagctcaatgcagattagaagcacaagtgagaaggatggtgggaagaaagcttttaaatgcaggcgcatggctgactgtaataagccaccgcttataggctgggtgcggtggctcacgcctgtaatcccagcactttgagaggctgaggagggcggatcgtctgaggtcaggaggttgagaccagcctggccaatgtggcgaaaccccatctctactaaaaatacaaaaataagccgggcttgggggcgggcacctgtaatcccagctacttgggaggctgagtcaggagaatagcttgaacctgggaggcgggggttgcagtgagccaagatcatgccactgcactccagcctggccaacaagagcaaaactccgtctcaaaaaataaaacaacaacaacaacaacaacaaaaagaagtgaccacttaaagtgaggaaggaaatataaaactataaaacacagacattccaggcatagtaacttagggtccttgaaggcaaataaatctgcactttagggtccctaaagtgtattaaaatataatgtagtatttgagcgtgataattaagaaggacaattgtatatcctttgtttaagaagatattttcagggaaagagtactgaaactgcaaggtttaacctactcatgtacttatttacaagctgcttttgagatttttaaattcaaaaatagttaaaatattatcaaaaatttggcactcaaaagcttcatctctctggaaattttacatgtggaacgtttcattatttcattccctagcagtccaaggcaattaggtgttaattgtagttgttaaaggcaggtcaggattcagagcctttgacttaatcagtttagtccaattcaagaagcagcgttaattgcctttactttggtgctcatacacagcaccagttacagtgttttcataattatcttcttttaagtccttacccagagaggaggcagtattgcgaagtggttgagagaatgggctctggagtcaggctgcctagggtcaaattctggccctactgtttactagctgtacaatgtaaatgacctaatctgactcaagccagttttttgttatgtaaaatagagcaagtaatataaccacctaataggagggctgtgaggaccaaagaagctaaaacatgtcaagtgttatagtttttggcaaatgcttaataaatgatggccattgttttattttattttattttattttattttttcattatactttaagttctgggatacaggtgcagaacgtgcaggtttgttacgtagatatacatgtgtcacagtggtttgctgcacccatcaatccgtcatctacattaggtatttctcctaatgctatccctcccctagccccccaccccctgacaggccctggtgtgtgttgttcccctccctgtgcccatatgttctcattgttcagctcccacttatgagtgagaatatgcggtgctttattatttttacaaggcccctattaggaaagttttgtgtgataatactaaataatgttttttattgcttcttagggtgaaatgaattggttttttttcatcttggcacatgatacaaatcattttagccaactttgcaagttataaatatgccttcactttttactaggcattaatgttctacaaatggatttagaaatttgtcacaaaggaattctactcttacagattaccctgttaaagacagttttaggcttaatagacttgaaattgtagtagtttgaaatgttcctacctaccaaggccttaacaactttgtaacatttaacatatacctcaaacatgagtgtcttttgttactagttttttatttagtgatgtcacccagttgcaagcaggatcccattttaatcaccagctcaatatgatatagctttttcatgttccctgtcgttaaatgtgctggaacttgacaggctataggggacctttgctgtattccagaaattggtctcaggctccccactactgacagactgccaaagtgcctttgagaaacttggagcatttcagagctgctgaagagactacactatcatgtgtgtcccatgtactcactcacttcatcctcatagaagttctatgaaatagatggttttacccccttttgcagaggatgagatcgaggcttggagaaatgatttgatcacacataggataaatagtagaaacaatattgaagcaaggttcatctgctcaaaagcctatattttactgtctcctcgtctctcaaaagaaaataataaattactctgtatagtttgtacacagttatatgtaaagccccaccagaaccaatctagaatatttccatatatttccatgtgtgtcagtaattagccaataactttgatcctatgaatcaacagccagagagtactgtttttgaaactagtggcacacaagaaataaatatggcttcctggtttttttttgtttgtttattttgttttttgacagctaaaaaacctgttcagatatctcaaggtgtgagggttgctggaaaggccaagtttcttcccttctctacctcatatggggcttaattttaaaatatcttacccttcttacctttatgcctttgttgcaggtgattggcatcctgaattttgtaccacatggaaatttgtgccccttaaaggtttttcaggctaggtgcagtagctcacccctgtaatcccagcactttgggaggctgaggtgggaggatcgcttgaagctaggagttcaagaccagcctgggcagtaaagtgagaccccatctcaaaaaaaaaaaaaaaaacaaacaggtttttcatttttgctttttaatatttgttgttgttttgattgcacttgtattatttaagatatcaatttgtgtggaatcttctttctttttttgagtatggattagcctcagtcctaactaatcaactctagataaacaggattttgatacattgcagtgtaagtttgtcaggggaccaaaataattagcaatatatgttttcatttctggaaattgtcctttgttaacacatatttatattgaccagacattgtaattaaatgggtactattttatgacaactactttttttgttttctaaacaaatttaactccctcccctaaactagaattttatctaatttatctttgtatctctagtcttggtacatagtaggtaattcataaatgtcagctttgggtgtctggttttattttttgttttgagacaaggtctcgctctgtcacccaggttagagtgcagtagcacaatcatggctcatggctcctgggctcaagtgatcttcctacatcagcctcctaagtagctaagactgcaggtgtgcaaccccatgcctggctggtttatttttattttgtagagatggggtgtcactatattgcctaggctggtctcaaactcctgagatcaagcaatcctcccgccttggcctcccaaagtgctgggattacaggtatgagccactgcacccagcccataaatgtttgttgagtaaagggattgattttctgttactcaaaagtaatttttttaacaaattaagtttttattagaggtcaaggattcctctaccaaaggaatcattacccagtttggcatataaaaacatgttagtaggactcatttcttctcttggttgtgctccaaaatacgactttgaggaaaagtcacttaatctcttggaatctcagtttcttgatctgtaaaaagaggctgtgtgattagatcatcttgaaggtgcctttcaattcaaatttgcatcatgtaatcattggattttaccaaaaaaaaattagaaatggcatattaattatttaaaactttcctattgcataaccccaaggtataactaagtagccttatgctttgaagcagatatcagactgttcctattcaaaaaaaaaatgtgggggaaagggtgaaatggtgaaaagttacttttaaaaattattacatccaggctgggtgcggtggctccctcctgtaatctcagcactttgggaagatgaggcgggtggattgcttgagcccaggagttcgagaccacctttagcaatatggcaaaccccgtctctatacaaaagtacagaaatcagctgagcatggtggcacgtgcctgtagtcccagtacttgggaggctgaggtgggaggattgcttgagcccaagaggttgaggctgcagtgagccatgatggtgtcactgcactcaagcctgagtaacggagtgagaccctatctcaaaaaaatatgtattacatccagagtagtctgtttaagaacagagtcttgctccagtagaaaaatgagctgagagtggtacacagtggttcgttcctgtaatctcagtactttgagagactgaaatgggaggattgcttgagcccaagagttcaagaccagcctgggcaacatagtgagaccctgtctctacaaaaaaatacaaaatattagctgggtgtggtggcgcatgcctgtagtcccagctactcagaagactgagactggaggatcgcttgagaccaggaggtcgaggctgcagtgagccaagatcacaccactgcactccagcctgggcaacagcaagactctgtctttaaaaaaaaaagaaaaagtaaaagctgagaacaaaaatgggtatctctcttcaaaatcgatataaatgtctaatacatatgaaaattttcatccacactggaaatcaaagtacaaattaaaacaccaatgagatatacttttgcctgtcaacttggtaaaaaaaagtttaaaataacacttatttttggtgagggtattaagaaacaggcattcacagagcagtaggagtgtaaacaggtacaagttggcagtttgaaagtagtgttatgtcatatacaactatatatgtacatatgaagataaaagatactcagatctctaggtgataagattatgtatgaatcactttaattttcttctctctcttttttttttttttttttttaagagatgggatcttgctgtctcccccaagctggagtgcagtggcacaatcatggctcactgcatccttgaattcctgggctaaagcaatccttgtgcctcagcctcctaggtagctgggtctacaggcaatagccaccacacctggataatttttaaattatttgtagagacagggtctcactccgttgaccagactggtcttctccactttttttttctttttctttttgagatggagtctcgctctgtcaccagggctggggtgcagtggcatgatctcggctcactgaaacctccgcctcccggttcaagtgattctcctgcctcagcctctcaagtagctgggattataggcacgcaccaccacaccctgctaatttttgtattttctgtggaggtggggtttcgccatattcaggctgatcttgaactcctgacctcaggtgatccgcctgcctcagcctcccaaagtgctgggattacaggcgtgagccactgcgcccagcctctcttccactttttgttttccacattttctacgtgcacacaagacttttcagtcacaaaatatatacacattttttaaatgtggacttgtctgtagtaagtgtatagaagtatttgtcttctcatctcctctattcaacacctccttacttttatttctgaacaggtctccaggaaaagttgggctttcaacattcaaggtaagttgtgctttctgaaagttatgtttttagaaattgtatactttttattcgtgtttttgtgtaattcttcattttcttgcttttgcttttttttacttactttttgctcagtaatgtagtcattatgtcctacttggtatacataggtactctagaaatacctaactaaatattatgctgtaaagaaggaactgtaagtattttttagatttctactgatttttatttgtttataatatctagaataaaagaacgtgtgtgtgtgtgtgtgtgtgtgtgttgaaaaagtgatacttggccaggcatggtggctcacacctgtaatctcaacacattggggggctgaggtgggcagatcagttgaggtcaggagtttgacaccagcctggccaacatggtgaaaccccgtctctactaaaaaaaaaaaaacacacaaaaattatccaggtgtggtggcgcagacctgtattcccagctacttgggagactgaggcaggagaattgcttgaacccaggaaatggaggctgcagtgaactgagatcgtgccactgcactccagcctgggtgacagagcgagactccacctcaaaaaaaaaagcaaaaaattaatacttgcatgacaaaaatgtacagtaactgaaacacatgtatacttcttgtgggcccatgtaccatcactatatataaaaatcaatcccagcttatattcaggcagaggagtttggtattgagatattatgccactgagagccattttaagtataagatatcaccaaatggaactatttatatcagatagagtatatattgtatatgtatatttatatgtatgtgtaatctcaaacatgctatatttttttcagttccagtataccgaccttctgtttatacacattggataccagtctctttgataaattatgatatgtttatatgaaatattctacagtagtagaaatgaatgaattagttatatacaatgacatggatgaatttcagcactagagtgttgagttgggggtaactactcatagaaaaacatatacagtaacgtttcatttatattaagttcaaaagcatgccaaactaaagaatatattgtttagagaatagattgtttagagatacaagcgtggtaaaactgtgaagaattaccagggaatgagaaatacaaaatttaggatatcggtcattctctgagggggagagattgtaatggaaatggagaaggatacacaagagacttgaaaactgataataatgttctttttcttaaattgagtgcttaagaaaagttatatcataactcttacgctaaataaaaattattttgtatttacttaatatttaataaaaacagtctttaaaagtaataacgtgtagggttgaaatttactcaggacaaaaggtatatggttgaaaatgtagctttccttccacttctcatcccccacctctcaaacttcatatccagaggcgattactgtttatgcttataggtcttaaaagccatttagcgctaagatatttttatattataacaaatagatttggagaatttactttaccccgtaattatagattgtccttaacttgagtgaaattagataacaagtatacatatttagtaaataaatatgaagttggatattgttcatttttttaactttttattttgaaataattatagattcacaggaagctttaaagataatgcagaaaggtcctgtatattcttcaccatttccccagtggttatatcttaattatagtacaattttaaaatgaggaatttaacgttggtgcaatgcgagtgtatagttctgcgccaatttatcatgtgtatatttgtataaccaccacaatgaagatgcagaactatttcatcatcacaaagatctccgttgtgctacccctttataatcacacccaccaccttccccatatcatccctaaatctgttttccatctctataattttgtcacttaaggaatgttctataaatggaattatatactatgtgaccttatgggattggttgaaagggtcacgatccatccaagttgttgtctgtatcaatggtttgtttctttttattgctgagtagtattatatgataaacatgtactgaggctattgagtgcatattatgaataacagtatatctattgatattgtaatataaaggaaggcttgatatagttctgattgttggtgattttacagtctgatggaagagacatgtatacaaaagggcaatttatgaggtctcgatgtttgtaaaatagaatagacgtgttaactgccacaaggggtttggaggaacgagaggaagatagaattggcgtgagagcactgttacctgaaatagcagagaaaagtttcagggaggaaatagaacttttgctgagctttgaaaattgggagaggtttgcataggtagatagagaaaaattgggaaagcattgtagttaggaaatagtagggactaataaatatgcaaaagcatgggatttgctagaagcattgaaaaactgtgaccagtgtaaaagtttcagtggtagagtactggaaaataaattgaggccagattgtgatgagccttgaatgtcaggttacctgattttatcataatactatgtatacatgcattgaaacatcacattataccctgtaaatatgtatcatattatgtgtcaattaaaaattaaattataatttagaaaagagatggggcgcagtggctcacgcttgtaatcccagcactttgggaggctgagacgggcagatcacctgaggtcaggagttagagaccagcctggccaacatggtgaaactccatctttactgaaaatacaaaaattagccaggcgtggtggcacatgcctgtaatcccagctacttgggaggctgaggcaggagaatcacttgaatctgagaggctgaggttgcagtgagtcaagattgtgccactgtactccaccctggacgatagagtgagactctgtctcaagttaaaaaaaaatttagaaaagaactctgatctttaaaattttgaagcaggatatttttgggtttcttttccttgcttttcttttcttttctttcgttctttcttcttttttttttttttttgatggagtctcactctgtcacccaggctggagtgcagtgatgcaatcttggctcactgcaacctccgcctcctgggttcaagcaattttcctgcctcagcctcccaagtagctaggattataggcgcccgccaccacacccagctaatttttgtatttttagtagagatggggtttcaccatgttggccacactggtctcaaatgacctcaagtgatctgcccacctcaacatcccaaagtgctgggattataggcatgagccactgggcccgaccagtatatttttgttttttgaaggtctcactctgtcacccaggcaagaatgcaatggcacaatcacagctcactataacctcgaactcctggtctcaaggactcctcccacctgagactcccaagtagctaggactacagactcaaaccccacacccagctattttattttatttttattttttagagatagggtcttgctaggttgtccagactggtctgaaactcctggcctcaaaccatcctcctcccttggcctcccaaagcattgggattacatgaatgagtctctgtgccaggcctaaagtgggacatttaaaaagtcaacttttatatgtcttacagctgtgctgccaaggtggtttttttgtttgtttgtttgtttgtttttgctcgggaactaagaaaactggtggaagggtggaagaaagtttggaggaaaaagacttaggtgcaaagaaagctgtcaagaggcagttaaaatgtcaagacatgagactccaacaaagggaacagcattgaaaggagtggatgtatggatatgacagcgatttaagagttgtttactttttagaacaattttctcagcaaaaaaagagtggaagtcacatttataagtttttctccttttttaaaaaatttcactttagtagcttcccttcccttactactaaaaattaccagttacctgaatttttctataattaatgtttttagcttaatgttctttagtaggtaataatgaagatttctgtgagtgtagatcactttcatacaaatactttgttgggtgtacttattaaaattaaaaagctgaaatcttataaccaaatactgcaggggggttatagacagctctgtaatatccaacacaggtggaggtaactgttacatgaattgctgaaaattgaataagctaccataccttttaaggaagcaaatttttgataccatgatagataggagttagagaaattgcctaatagtagggaagctgggatttagtaagtactgcattttaataatgggtcagcacatcaccagaagtaggtaatggactgtctcaagtatagctaagttggcattggttgtctgtggacacatgcttggcttccattcctttgtcccaaaagcctgatcaaggtgttagaaggacctggatgttatacatcactgagagagaatcataattgactatatatcctaagtctgattttattaagaagtcttctctggagatcaggccctctggtaggtgccatatcactcctttaaacttgtgacttaaaacagcagagtaccttaggagttactatcttttaaaagttcagactccaagagagttttgttaaagccaaataaaatagaagtctgatcactgcttggcagttttggctagtgtaggaatgttaatcttttataagtaaataattgaaacaaattaggccgagtgcagtgacacataggccaagtgcagtgactcacgcctgttatcccaacactttgggatgctaaggtgggaggatggctgcattccagcctgggcaactgcgagaccctgcttctaaaaatcagttaatcaaaatgaggtccaaagattattaatgtgtaattttatgtagcttaatttagggaaaatatccacagaattatgctgtacaatgcttctgattttcctactgataaacagttattagaaaataattggataaaaataattagtaggacagttgaaggtgtttctctaatatgcattaactgttatttatttatttatttttttcttttttcctgcggaccccgttctgctgagagcatcaactattcttaatggtgatcagcttccaagtattctttttttttttttttttggagacagagtctcgctctgtcccaggctggaccaagtattctcttaatggtgatcagcttccaagtattctctctccaccttgtcaaggttatcttatcaattggtcttggttagatttttatttcttttttttaatttctttttttttttttttttttgagacagggtcttgctttcttccccaggctggaatgcagtggcattatcatagctcactgcagcctcaggctcctaggctcaagtagtcctcccacaacaacctccaaagtagctgggactgcaggcacataccaccatgcttggctaattattattttttttagaggcgaggtctcactgtgttgcccaggctggtctcaaactccgggtttcagcctgtgcccggccttctttcatataaaaccaggatccaattaaagcctatgtaaacttaagatgtatgtattaactgaagaaaaaacagagcatgcatcattcaacattcattcagcaaatgattatttagtgctggacactgttttaggtactgaacaaactgtagatagaacaaacaaggtccatctctcatggagcttacattctagtgggacagggaagagacaaaaaataagcaagtaaataaggtcatttcgaacgataagtgcaatgaaggaaaataggataatgttttcccagcaccatttattgagtagggaagcctttccccattctttgttttcatcaggtttgtcgaagatcagatagttgtaggtgtgcggtcttatttctgtattctctattctgttctattggtctgtgtgtctctttttgtaccagtaccatgctgtttggtaactgtagcactgtagcatagtttgaagtcgggtagcatgatgcctccagctttgttctttttgcttaggatttgccttggctattcaggctcttttttggttccctatgaattttaaaataaaatttcctagttctgtgaagaatctcagtggtagtttaatagtaatggcattaagtctatacattgccttgggcagtgtggccattttaacgatattgattcttcctatccatgagcttggaatgtttttccatttgtttgtgtcatctctggtttctttgagcagtggtttgtagttctcctttcacctccctagttagctgtattcataggtattttcttttcgtggcaattgcaaatgatgggagtttattcctgatttggctctctgcttggctgttattagtgtataataatgctagtgatttttgcacatttattttgtatcctgagactttgttgaagttgtttatcagcttaagaatcttttgggctgagactatgggttatctagatataagatcatgttgtctgcaaacagggatagtttgacatcctctcctcaatcccattactgggtatatacccaaaggaatataaatcattctattataaagacacatgcacacacatgttcattgcagcactattcacaatagcaaagacatgaaatcaacctaaatgcccatcaatgatagactggataaagaaaatgtagtacatatacaccatggaatactatgcagccataaaaaagaacgagatcatgtcctttgcagggccatggatggagctggaggccattatccttagcaaatcaatgcaggaacagaaaaccaaatactgcatgttctcacttataggtgggagctaaatgatgtggacacatgaacccatagaggggaacaacacatgttgaggcctatcagagggtgaagggtgggaggagggagaggatcaggaaaaatgactaatgtgtactaggcttaatacctgggtgatgaaataatctgtgcaacaaaaccccatgacacaagtttacctgtgtaacaaatctgcacatgtacccctgaacttaaagttaaaaaaaaaaagaaaaataggataatgtgatagaaagttaaggagtcagctaaggctattttgagatggtcagggaagtattttctgataaaatagcacttgagctatgaccctaatggcaaggaatcatcctattggccagaatgtaattgtgggggagtgatatgagagggagatgaggagtgtagaagatatcaaaaatgtaggcagaggctatgtcatgtttaggccttcatgggccttggtactgtttggattttatctaatacttaagagtccatgaaacatttttttttttctagaagaatctgtgtaagattggtagtattctccaaattctgggggaggaattcagtgctcgaagatattgcaagtcctacagaaatttcactggcacgttaaatctttaacattttaataatctctggagtaatttcattattgagcctattgtgatcatatcctgatacttgtataagtgccacctaaataattaatgtgccttgagtcctttatctgtctaaaatggttataatgaccttcctctaacaaactctgtgatgtgcacaaagaattatggttttttttcctcagtatcaagagtagcattcaaattgctgtgcttctataaatagacaacttaagattgagaagagtattgtattgagatttgcaaatatatgattgtcttattttaccctaattttttccagcagaaatgcagtatccatttctaacctcccaaatatatatatatatgtacgtatgtgtatataaatgtatacgtagatatatatgtatttttggtgggtttaatttttttcatcttttttcatagtttttttaggggcttcatttaacttctggttaagtcttgatttcttttatctaaagcatgtagaattttaagaaaactattccctgaatgtggttttctgtgttataaacttttgtatttgtgcatatttatggagcaatgctttggggaaaataacaatttttattcagccccttgcttaaatccttaatcctttttagctataaaagtacgtagaagttcttatcgtccattacagttttttaatgttaaaaagttgagcaagttttcacatttaaaggtaaatatcctattgcagaataatagaatattgctgatgggtaactttcttatgcaaattacattgtcccatttggcataaaatttctgagcatctatcagtattcagaaatctaagccctttaggctgggcacagtggctcacacctataatcccagcactttgggaggctgaggtgggtagatcacttgaggtcaggagttcaagaccagcctggccaacaaggtgaaactctgtctgtactaaaattacaaaaattagccaggtgtggtggcacgcgcctataatcccagctactcgggaggctgaggcaggagaatcacttgaacccgggaagcagaggttgcagtgagccaggattgtgccactgcactccagcctgggtgacagagtaaaactctgtctcaaaaaaaaaaaaaaaaaaaaaagaagaagaagaaatcaaagccctttaagggcctttgatttattaatgctacattttctcatttgtacccctttaaagcatatttttaaagaaaagatgtcatcatttggtctctatttcttttctttttcaaacaggaaacagagaacactgcatacaaagttggaaatgagtcccctgtacaagaattgaaacaagatgtgtctaaaaaggttggaaagatacaatgtcaatattagtttatagcagacatcatatttatatggtatatttcaaacagcttttatattcttttagtatagcgctctgtacatggctgatgttcagcaaatgtttcatgaatctgtcacatttgtggttgaagacatttcagtctttttagaagtccttttcatattctaattggtaatttatccttgagacaatattttgtaaaatgcttttattttttgttcttgtatttttatcagaataagccctaactcttcttgaggttactaccaggagttatgggtattgaaaagctcagtgcagcaacattctgatgtctttaggaatcagaagttataagaagtccttactctgatagtacctgataccttttaaaaaattgatgctatgaagcttcaaaggttggtttactagaagagactgagcacaagatcagtattttgaaaatgggcagtttacagtatcaggataaaactcaaggagaaagacaggatggtgtgtttttattcatttatacaagttttaagtgttttctgtgccctaggcaatgttctagccagtgggtttccagaggctaacaaaatgacacattctccaccccagagtttctccagtactggcactcgacattttgggctaatagagggtaggggaaggcctgttgtgtgcattgtaagatgttttagcagtatccccagcttctacttactaaatgccaatagcatcctcaactcccaattatgacaaccaaatatatctccagatgtctgggaaggggtatggaacaaaataacccctaatggaaaaccactgttctatccttatggaatttagaaatttaatggactacattttttttttatttgaggcagggtctcactctgtcgcccaagctagagtgcagtggcacaatcatggctcactgtagcctccacctcctggactcaagtgatcctcccacctcaccctcctgagtagctgggactacaggtgtatgccaccatgcctggataatttttgtatattttatagagacaaggttttgccatgtttcccaggctggtcttgaaattctgagctcaggcaatccacccacctcagcctcccgaagtgctgggattataggtgtgcaacactgtgcccagcgagaccacatattttgatattgatcatactttttcctttaaaggaaaaatgttcccttttgggacgaatggtggattgcatagcagtgtacataacaggaattgaaccatttttttaaaaaaataagaaattgcctataattctatactataacacacaggtgtcttgatttttcagcatttccttctggtcctcatccattagcatacatttttctgcctaattgtagtgtaggtagaattttatattctgtcttttactcttaccatttttagattttcctcatacttctatatgagttctgtactcagatgcatcagattccatcaagtaaatggattacaatgttatctagccatttttattgttgaaacttaaaatattcctgttttttccactatagcttttcttattttttaaagaatgtttttcttaggataaataacaaatgtataactatctatagttagtggggaaaaaagatgattttaaggagagtttagaagtttaaacagtagtgagaaaacactgtggagcagaatgaggtttaagattctaaataatcactttttaagttctagccttttcagttgaattaagtatgaatcactaatgataaaggctatggggatataccctggacgagggcatactctgctctcgagtaacttacattttagtagaagaaattggataaacacaaaactaaatgcagtaagtattcaaataaacttagaagctattgtaagaacacaaagggaaggagacttcttgcttgggggtaggaatgaagatgacttcatggaggaggtagcatctgagctggttcttaatgaatgcataagatttggacaggctaggccgggcacggtggctcacgcctataatcccagcactttgggaggccgaggcaggcggatcacctgaggtcgggagttcgagaccagcctgaccaacatggagaaaccccatctctactaaaaatacaaaaattagctgggcgtggtggcgtgtccctgtagtcccagctacttgggaggccaaggcaggagaatcgcttgaacctggaggcagaggttgcagtgagctgaaattgcgccactgcactccagcctggtgacagagctagactccctctcaaaaaaaaaaaaaaaaaaaaggatttggccaggctaagatgggagaggaaaggcattactgaaggcatggaggtggggaatgtgcagaacatttgaggatgagcctagagagcaaagttagggctggattataggaatgccttatgtcatactaaactgtctgctttttatttatttatttatttattttttgagacttgagtctcgctctgttgcccaggctagagtgcagtggtgtgatctcagctcactgcaacctccacctcctgggttgaagcaattcttctgcctcagcctcccaagtagctgggtttacaccaacacaccaccacgccaggctaattttttatatttatttatttatttatttattttgtatttttagtagagatggggtttcaccatgttggccaggctggttttgaactcctgacctcagttgatccgcccacctcagcctcccaaagtgctgggattacaagcataagtcaccgtgtccggtcacagtgagctttttgcagcaaacaatgctttagcataatcatctctatgtgtgtcttggttctcattgttctcttagtctttccgttttcactatttcctaaaatccagaaaaaaatgacagggctaggcaccataagaaggtgtcatgaggcatatcaagaggcaaaaaacatggacctttctctccaggtactaattatctggtgtagagaaaataaatagagctagcctatatacagctctgtatttgtattatagttcatactatactgaacagtaagaataataatagaagtgcagaggagggagagattattatcagataagggattggggaagatgcattttcaacctcattttgacccctcttgtggcacagacatttccattatgtgtagtgattatttcaaacctttatactcacctcatgctcactgtacccactcacatccccctcactttcagccgataaccttgtttcctactccacgtaaatattagaggctaaaaagcctgaatccattcctttgtatcatctttcacttcctttacctacatatttattgttatttcttacctttttttcatgtcatccatcactgaagatttagtattcttgttttctgtccaaagtagtgtggtataatacaaagatcactggatttttaagtaagacctggatttcagttttggctttgtagcttactaattgtgggactggcaaaattcttaaagcctttacctcagagtcctgcttttctaggagggaggtaatccagctacctaacccaaaggcctgtatgacaattaaatgagaatgtgtatactaggtctaatacacagtaggccttctttcctttcttttccagaacattgctctgttatcttcttttccagtagttccttcccttcaggttataaaagtgctgggtcactttatcgaagtctttttgcatttatagctaagctttttgaaaactcagaccgtgctaatgtctctgtatcttcacctcttattcaatctcaaatccattgtaatatgacttctgttatcactgttatcattgaggttctcagtgctcagtaaccacctaattgacaaattggttggactctggttagttttggtgaaagcaaggtaatttctaaggttaacaatttgaagtttgagaaaaactaacatatagaacatgctaagaaatcagggatgaatattactgagcagcagtaatacccagttcaagttagcatgaaattgtagtaaaccagattaggatggttctatgatgcattctgttaactttctgaagccagggaattgagaaagcagaagttgttcatggttggacatggtggcaggataagtgatctgggagatttaatattagtaatgacaagactggggagaaaatatattctaaatgttggcagaagataatagaaagcctgtttatattttaagctacatataagaaagggggccaggcgcagtggctcatgcctgtaatcccagcactttgggaggctgaggcaggtggatcacatgaggtcgggagttaaaggccagcctggccaacatggtgaaacctcgtctctactaaaaatacaaaaattatcccggcgtggagcacctgtaatctcagcttttagggaggctgaggcaggagaattgcttgaacctgggaggcagaggttgcagtgagccaagatcgtgccactgcactccagcctgggtgacagagtgagactccatttcaaaaaagaaaaagaaaggaagggaaaagacaaggtggactgggtatttgaactcttttcatggtcctgccatcagtccacatagtggagtttaggtgtagtctgtttaagaatgttaatctccctgcatctgctggtttttgggtcataagcttgagttcagagctaaacaacttgaattcttctcctggggatttggattatcgtggtttggttaagtaggctcaaaccattaggctggtattacaacaagtttggcataaatatgtaaatgaatcaggatattgagtcttaatgtaagtttaggattgaacttgattttacaggattatttgatcttttgtacctaagtattaacacaaatttgctattatgagggttaagagtatagatgctggaatcaaactccctgggtttatacctgcttcatcacttactagctttgtgaccttggacaaatcatttgattagttccctaatttgtaaaatggtgacagtaggagtagaatctcataaggttgttgtaaagattaaaatatgtaaagtgttaagaacattgcctggcacatactaagtactatgtaaatgattagctgttactgtgttcttataaatagcttcatttttaaaaactacttttaaccctttcatcagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccacc

SEQ ID NO: 5854 - DNA, 190265 bp, human
gcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaagcatttccagttcagaggctctcaatgaactgagctgtcaatgaactgagggtcaggaaagttaaccagagtgttagcacctaaacataaaatagtctcgctactggaggttagcagggcccagagcaagccactccaccacgatctgtacaaaagaccggtgcaggttgctgtgaagccagagaggcctccttgctgaacccttgtttaagcaccaaataggaaaatttgttttctgagactaacatgttaaaaaattctctggattgagtctttttctattctaatcaccagtgaacctttgttttttaagctttcattgctttttttttttttttagacggaatctccctctgtcgcccagactggagtgcggtggcgggatctcggctcactgcaagctccgcctcccgggttcacgtcattctcccgcctcagcctcccgagtagctgggactacaggcgcccgccgccacgcccggctaattttttgtatttttagtagagacggggtttcaccgtgttagccaggatggtctcgatctcctgacctcgtgatccgcccgcctcggtctctcaaagtgctgggattacaggcgtgagccaccgcgcccggccttcattgctttattacatgccaaatgcttgtttattgtacaacagctagaaaaacagaaaagtaagaataattatcaccatctcattacccagaggaagctccgtaaatattttaatgtaaatatttacctttctctctttctatgtgtatatatacacatctataaatacacatatatactgtatatatagatgtatacatatctatacatacatatacatacccacacacatatatggatggaaagaaatatacacaaactttttatttttgtttatgtattttttttttgagacaaagtcttgctctttacccaggttggagtgcagtggtgtaatcatggctcactgcagctttgacctttgggactcaagggatcctcccacctcagcctcccaagtagctgggactgcaggcaaacgccaccgtgcccagctaaagttttttttgtttttgttttgttttgtttttttagtagagacagggtttcacagtgtttccccaggctggtctcaaactcctgagctcaagcagtcctcccaccttggcctctcaaagtgctgggattacaggcatgagccacttcgcctggccacacaaacttttaaataatttttttcatttatcagtatcttatgaatattttttgatgtcaataaatacaaatctatataatcatatttaatgactgcctaaattttcattatgggtgtaccagaggtaattatcatttattgtttgatattttgatagtttttctaattttgtgctgttataaacatgaactataaaggtaaatagctatatatctttctttacttttaaatttaaattaattaaaaataatcatatccaggcatggtggctcacacctgtaatcccagcactttgggaggctgaggcaggcatatcacctgaggacaggagtttgagaccagcctggccaacatggcaaaaccccgtctctacttaaaaaaaaatacaaaaattagctgagtgtcatggcgcatgcctgtagtcccaggtactcgggaggctgaggcaggagaatcgcttgaacccaggaggtggaggttgcagtgatctgagatcccaccactgcactccagcctaggcgacacagcgatactccgactcaaaaaaagtaataataataatcagtttctaaatttcacttgccacagttcaagtgctcaatagccacatgtggctagtggctactatattggactgcatatactatatatgcagataaagagcattaccatcagtaactgagtgaatgtctttgagaaggcatcttcaaaattgccaaatcgtccccttaggataaatttctagcagtgaacttgcttgctcaaagattacactgtatgcatttttagtattaaaaattcctcttaaacatactgttaaattgctctacagaaagtagcttcagtttactctttcaccaggagagtgtgagggtgttcatttcccctctcccatgccaacgcttgttagtaatattttaaaaattttttgcagtttgataggaaataaatggtacatcaccgttctaatttgcatttctttgattactcttaaagttgaacagtttttcatgttgattggcctttcatagttcttctgttgaggcttgaatgaatctgcttacagacttatttcctcgtttgtgattcttgcaatacagtctccatcccccaagattctgttttgctaagtctggggtggggcctgcatctgtattctttaaaaggaccccagatgattctcatgtgcacagaaacactcatctagaccgcttgtccactcaaggcaggaatgtcctttccacccagccctgacaaatgattatttagcttctccttaaacacccctgcctgttagagggctatgttagaaaaggttcttgagccgaaatttactgtgtaaatttcaccatgggctagacctagctctgctgttggagccacacgtttgcttccttcctcttttgcataacaacctctcaaatatttagagacagccaccatgtcattttaaaattcactcttcacaaagccaaagaggctacatttctttccttcgttccccacatgacttggtttcaagattcttcatatcattatcatcctgtttgggctcttttccaagttttctatgtcctacttaagatgtgagagacagagcataagctagaggatcagatctggtcttgaacccaacgtctgtcacttgcctgaattgtgaacagacgcaagtaacctggtctcattttccttatctgtgaaatgggaataaatagtagtacctcccttgtggagttcttgggaataacgaaggtaacatatggaaagtttctaatgtataagtgattcataaaggttaaaaaaagagatctggccaaaacaaaacaaacaaacaaacaaacaaacaaaaaaacagtattccagaaggatctgccactgaatacagtcagggagggggcaatgttttgtatcatttctgggtgtgagccgagaagccgggggctgtgtattcatttttattcccagcccagcccctcacacagtgtctggagtgcagtagattcttaggtgttttgtgaaaatacactgccaaccttgggtaggatggactcattgttgggagaagagcctggaggccaggaaatgacttaaaatacagttaatatagttctggagagagataacaaaggcttttttttttttttttgaaatggagtttcactcttgtcgcccaggcacgatcttggctcactgcaacctctgcctcccgggttcaagcgattctcctgcctcgggctcctgagtagctgggattacagatgcgtgccaccacgccccatataatttttgtatttttagtagagatggggtttcaccacgttggccaggctgatctcgaactcctgacctcaggtgatccacccacctctgcctcccaaagtgctgggattacaggcctgagccactgcaccaggcgaacaaaggcttttaactgaggcaatgagaatggagataagggagaagacataagaaacattgtgctgagaaaatcaacaggatttggtgattcttaaaagggaaggagaagggggaggaagaaagagaggaagagcggaggtggagtcaagataattttgaggtttctcagcttgtgtgaactgaaggaaaagcaagtttgttgataggggaagggaaaagaaaatgagcaacttctgtttgagggagttgtcagggcaaagccaggtttcagttaagcaagatggtggctgagcatataaggttgtcttttggcaaaggactagggttctcgagggcagaggtggaaagtgttccaagtgggttcaggaagaagaagagccaggaaaaggccagggctgagtggacagagatgaaattgtaggcgagattagctgattgaagaggtttgcacctttgggggtgattagggaagtgggaggcagggtgtggggaaacgatctggaggccagccccagacttccagttagaatggggtggggatgggaagtgagtccaccccttgggcagatcccactctggggtgggtctgagcagcagttgccctgaggagcagggggtcagtgaggggttgacttcctgctcaggtgctcaggaagaggctaataggatagttcctgcttttaagggagactagaagtacgcaaataacctacagaagatagaagccagataggagtccagtggtcattggtttcccagtcttcaccccatctccgacccccaccccagcccccagtgctctctcttaagatccttaacgtttttcaagactttcgtcctttctgggttcgacaaggttaaataggcctttactaatgaacattgttctgtttatggcatttcccacatttatttgaccacagaccctgccccacccccaaccggctttttatggaaagtggagagtaaatggtaacatctaacaggctgagaaattcctatatagtgtgcgtgtgtaactaactcatcttggcgttctcttacttgacctctgtggattgcaagcagtggttgctactttcccatgctccacgtcaagaaccacccttgctgttcagttcagaggagtaattcacctgtctgattgtgctttctcctgagctatagaattgtcagcaagtcatgttgaaagacgattagtttttaaaaataatttgtttatcatggaaggggaggccaaaactacatgagggtacagctcgagccatttcttctgtaaatcctaagggtacttagaatacgtttctctttgagatttacccctcttggtttaatttttatcaggcatgcagaggagttggtgggtaacattggcctgccgtttatatcagcctacagccagatgcctttttgattccttgcaggaccccaccctggacgctcccagagcagtagcttgaatggagcaaagagacagtctcagttagctgccattgcctttgtaagcttgtgcttcagagcaaagtggttaagagcttgggctctggaagcatgctgcccaggttcagagttcagccctagatgaccttgggccaattatttaaccttcctgggcattggtaaccccctcaggggcttgttgaaaggcttaaatgagttatttgttttgttttgtttttgagacggggtctcgctctgtcacccaggctggagtgcagtgacacgaacttggttcactgtaacctccgcctcctgggttcaagtgatccttccatctcagcctccctagtagctgggactacaggtgtgcaccaccattgcccggctaagttttgtgtttttagtatagagacagggttttgccatgttggccaggctggtctcgaactcctgacctcaaatgatccgcctgcctcggcctcccaaagtgctgggattacaggcgtgagacaccatgcccagccttgagtgagttattatattcttaatgtataatattgaaagcacttcaagtggggtttgccaattgttaagtactgatgactgttggctcgcattatcatccccaggctttatggtgggcaagagacgtcttttgtatatgtgttacaagtcagcagacagaaaagttaactggaagaggggaagcaggtacccttgctttaattccttgctccagatgatgccccaaaggggtgagccacatggctgatccaagaatcttacccttcctggaagaacaagctggcagacccctctgcatgaggttcttgccaatacccgttcccagtctgacttagtcatactgaaaagcctagtggatggtagcaagggttctgggtttttggcattttctaccttcacacgagtttaatgagtgagtgggaaggctggtcctcaagtggggagaagcactctgtcctgtgccttgggccggaaggctctccagactggggaaactgtacctgtggcctttggcagaagcacttacctttatgccagcctgttcagtgtgatttatgcaaaggggtgaatagaagagaattgggatctgtgtggaaaaacagagcttggacatgcctacctttccctttcaaaccttcactgatgccaggcacgttagcctatgcctataatcccagccctttgggaggctgagctgggaggattgcttgagcctgggagttccaggccagcctgggagatacagggagacccccatctttacaaaattaaaacaaaaatgagccaggcgtggtggcacatgcgtgtagtccagctacttgagagactgaagtgggaggattccttgagcccaggagttcgaggctgcagtgagccttgattgtgccactgcactccagcttgggtgacagactgagaccctgtctcaaaaaaaaaaaaaacaacaaaaaaccaaaaccaaaaaacctttattgttatccctttcactcttaatcctcacatttaatagtcaaataaatattgaaatgcaaatgcttttttaaagttctattttggggctgagcgcggtggctcacacctatattcccagcactttgagaggccgaggtgggtggatcacttgaggtcaggagtttgagatcagcctggccaacatggtaaaaccctgtctctaccaaaaatacaaaaattagctgggcatggtggtgcacgcctgtaatcccagctacttgggaggctgaggcatgagaatcacttgaacccgggaggcagaggttgcagtgagctgagatcacgccactgcaccccagcctgggcgacaaagtgagactgtctcaaaaaaaaaattatattttggaaacatacgttttaataggaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaggccaggagttcaagaccagcctgggcaacatagcgagacccccgtctttccaaaaaaataaaaagaatagtgcacacaggttcctagcagagtcagtacagtggaaaacatgccgagtgttccagctctacgtggttcatcttttgtctgtgtgcagccttgcacaatcatgcctaaatttgctattaatgatttcctgcgattcttctccacttttattgcctattgagtttattgttcatgggaagttatgtgcttttgccgtttttgacttctgttggattgtgtatatgtttcaagctgctaagaaatgttagaagatattctgatacttcagcgttcccatcgcattgctttccctaatgactggaaatattttactgggtaagatttaactgagaagtcaagtgttgcttccaagtctctgagacagaacatctttatttgaagtgtttcagtgaagtgtgtcagaaggctggggaattcatttgtataagattttttttttttttccggagacagagtcttgctctgtcacccaggctggagtgcagtggcaacctccgcctcctgtgttcaagcgattctcctgcctcagcctcccaagtagctgggattacaggcatctgccaccacgcctggctaatttttgtgtttttagtagagacggggtttcaccatgttggccatgctggttttgaactcctgacctcaggtgatccatccgcctgggcctcccaaggtgctggaattacaggcatgagccaccgtgcccggcccgttttttaaatggtgacaagaccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggacaaaaaaaaaaaaaagagggatggggttgttattgagaaatgtgggcaagatcagtatagatttttgcttgccaaagtaagcctaaggatattgagaactgtttgcaattggccatccctccttactttgctatttgaataactatatggaaaaaaatatccagaacactggctctgcagaggtacctgggatcattttcatggaactgttttcatgatttttttcaagtgggttagtgctgtccaaaaataacaacatatatatttctttccatgccttttatattagtagtttagttttcccacttgagaaactgccagctttatgccttgcagggcctgttgtcacagtgttcacggtgtgaatggaagagtgctgttggcatggccagtttactttcataggtgaacacgttcctaatgcttcagtacattaaatcgtttcctagagatctgaaggagggaatgctaccttccaaggtacctaccttcccaccaagaaataacttaagttcaagaaggttctaaatcaaccggtacatacatggaactgaatcgttatttcaaagctcacaggggccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagctttatggtctattagtttcctattgccactgtaatgaattgccacaaacttagtgtcttaacacagatgtgttccagttctagagatcagaaggccaaaattggtttcactgagctaaagccaaggtgtccaaaaagcctcacttcctccagaagctgtaggggaggatccattgcctggtctcttccagcttctagaggatgcccacattccttggctcatggccccttcctccctcctcaaaccagcaatgactggtcgagtctttctcacatcctatcagtctcacactgcttctgtcattatatctccttctctgacaccggctctcttgcctccctctttcacttataaggaccttggttccaccttggtaatctaggataattgccccatctccaaatccttaatttaatcatgcctgcaaagtcttctttgccatgtaaagtaacatattcacaggttccacggattaagatgtggccatcattgaggaaccattattctgcctatcacgcaagatgtcacccaagtttgaggactgatggaatcctggggtcagaggggttcccagcacaggtcctgacattacagtggaggaggaacagggatctggcaaacagccaggcgcagaagtcttcatagaattcaaatgaggaagcacaatcccttttgcgaattttggctgaaagaaagcaatacaggtctgcagtctgcaatttcaattgacatgttttcttaaattcttcataactaaatgtctttccccacacaggactccctgagcctggagttcttatagcgggcactgctttcagacttgaggtgttttaggatacaagctgggcagacactttgcgggcatttagccagctcaggcctatagaattttccaccttcagttaaagaaaagagcaaagaggtaggggtgtgtgtgggtgtgtggatgtatgtgtgtggcggggggtcagcggggaggtgtttaaaagagaaagcgatggttgcacatcacataaaataactatttggccacaagtcccaagatacctctcatatgtcctgtgtaagagatgctttgcccagcctgaaggtcaagttagactgggcatggtccttctgcattttcaaggtaatcacagaatcccttcccagaaatggctttctaaaacacatgattggagaagcagaaggaaggactggaaaatctatctgagttctttctggcttcatgatgatttcaattaaaagataaatggaaacttcccctctctaccacatctagtcactgccatcttagagacacatagaacaaaagtttcctggctgataacatttgcatcagccctcctcacactggccagtatgatgtccatgatgtgtctgatggcacagagctttgctgtcctgaagaagcactctatcgtagatgtggattgcatttcctatttttaccttggttctaattggccacggccatatttctcccaggcccagcatatcttttttcaagcctctggctaattgacctggctgtaatgcactgaaaatcattatagaaaaggttggggaaactcccagattgtgtttgaaaatctgtagagacaaaatacacattcactatcttcacttttctcctgttctattttttctttttttcctcctcaataggaaaacagtttcaattctccttataaaccatctcagggtaaatattcagatgttttcagtggaattatgttaaaccattttttgaaagtgcttatctacgatgaatatctactaattattaaatgtgaaagggtattaactgtagtcctatttaaatcttttttagaaaatggtgttcattttctgtaaattgtgggtttattctcttcaacctggcttatttgattttattttgcgatttactactttctgctttggagtttctccttttctctattggctgtcagctgaacttcaccgaggcttctgggtactgtgcattaggtcaatgagcttcatgacagagttgacgcctgggaaccctggaacctctggggctgtgttatgcagcagaaggaactagaaaggaggagggcgttgctggagagtgagctagagagagagaaagttgtgctgagctgtggaagatggctcccctggctgagggagaagacagataccgtcgttcagttcatgctcaaatcccaagggaaatgtttgtgaactgttgcttgaattgaagagaagcagagaatctatttccgcttatttatttatttattttttgagaaggagtctcactctgtcgcccaggctggagtgcagtggcacgatcttggctcactgcaaccaccgactccggggttcaagcaattctcctgcctcagcctcccgagtagctgggactacaggcgcacgccgccatgcgtgtattttagtaaagacagggtttcaccgtgttgcccaggctggtcgcgaactcctgagctcagacaatctgcctgccttggcctcccaaaatgctgggattacagcgtgagccaccatgccctgctccgctgatttctttttaacagatcaaacctacttacgacaaggaggtaggaggaatggtggaaggcaagaccagggcttaatctcaagaaactgaaggattaaaaaggggcaaaaggaaggtattttttttccattacaaagaccaagagaccagagattaaaatattaacaatatttaatgagtgcagccgtatatttttagattcagacaggaagagatcaagtcctttagaaattgtgcttgataaatgaaacagttttgtctggcaccaaaggggtgagtagatacttattcaggggctggagacagtgcatatactgtcaacttgcatgatgcaggacctcaaatcagttagttaaggaattgagaaaatacttgtatgccattcagcatataggatagttggaacatagggaaactcattctccaacttcaatggaggtcagagacacatgaccatcagacacccataggggccagatttctgttgggagcccagggtagagggactcaggtgctaggtctgcctgccctccttttttccatcctatcctctaccagggtagaaggggagccaacagctcatgcctctgccagacccgtgtttctcaaggcagaaaacgctgcttgacaggaatggtggccatagaggctgccactctgagcccttgtgaccttctctgagagcagcccccactgggactggcttcttcttactgactacattctctttcttgcaagctactatcttcccctttccaccttctactattccctaactgctttccccccattctgattttcctcaactgctgctcctggtgtttgcctctgcactgccaccttccaggaaactcttctgtggatctggctgcctgatccagctccttgacttctcccttctaccatgccctgggaaccattgtttgactgtgggcacactccttctctccccttctcatctttttctcacctcttctttctctctcctctgtttggctaaaaagtgtgctttgtggcacagagccatcactgtgtttattttttttaaaccttttctttagccaaggatggaaaattccaaaggcctgagctagtgatggctggatgccttttctggaaatccagtggcctgggtgccaagggaatgttgtggagctacacatctggcaaggttgtcccctaaaatgtcctggctttggatttagttccaactgaaagaaggggaggttctatctggaattatggaatcagaatgaagagttagctaggtgtggtggcacacgcctgtggttccagctactcgggaggctgaagcaggaggatcacttgaacccacttcaaggccatggtgaactatgattacaccattgtactccagcctgggtgacagagcgagaccttgtctcaaattttaaaaaaaagtgaagagtttacgaaattatgtaattgtaaccccagagcccagtttatgtcactgtttttttctgctgggtttaattgggaaagagtggcctttgacttagtagatctttaaaaagtgaaaccttttgcatgagagtcaaataaagttcttgcacctcagtttaatcgatgattttgcttcgttggggttacttggcagaggccaggcacacttcagagcacctggagtgggccttatgggggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaattaccacaaattgggtggcctaaaacaagtttgttctctaacagatctagaggccagacgtctgaaataagtatcactaggcctcactccttcaggagattttaggaaaggatcatttattgcctcttccagctctggtagctaccagcattccttggcttgtggttgcatcactccaatctctgcctctgtggtcacattgccacctctttggtctgtttcaggtctcccgctgcctctttcttatcaagatacttgtgatggcatttagagtccaccccaataatccggatgcgctcttcatctcaagatccttaatttatttcattttgttttgttttttgagatggagtttcgctcttgttgcccaggctggagtgcaatggtgcaatctcggcttaccgcaacctccgcctctcgagttcaagcgattcttctgcctcagcctcccgagtagctgggattacaggcatgcaccaccatgcctggctaattttgtatttttagtagagacggggtttcttcatgttggtcaggttggtctcgaactcctgacctcaggtgatccgcccgccttggcctcccaaagtgctgggattatagatgtgagccactgcacccagccaatttatttcacgtctgtaaagaccctttggccatatatcatttgcaggttccagggatgaggatgggggcatatctttttgtgggggaggcattttttcagtctgtgtgttcttaggttttagagaggattgatatcagtactttcattttagagaggattgatttcattaggcctcctaagatagttgttgatagcttctctattgtattagaatgtaaataccttaaggggctggtaggagactagaaagctattgcttagtagtcagtgccagagggcccagcaattctactgacaatctgtgttaccttgggcagactgtttgacttttgggggatctccttttgcttatttgtaaacattggaagaataacatgaacatcaattggccttgcaaatatgtttataatagcaaaaacaaaaacccaaaaaagttcacctaaatgttcaaaagtaaggatttgggcaaatatatatatatatacattcttacaccagaaaactgtgcagtccttaaaatgacattctttctttcttttttcttttcttttctttttctttttttttttttttttgtgatggagtctgcgtctgttatccagcctggagtgcagtggcatgatctcgactcactgcaagctccgcctcccgggttcacgccattctcctgcctcagcctcctgagtagctgggactacaggcgcccaccaccatgcccggctaattttgttttgtatttttagtagagatggggtttcaccatgttagccaggatggtttcgatctcctgacctcgtaatctgcccgcctcggcctcccaaagtgctgggattacaggcgtgagccactgcacccggcctcctcctctcctctcctcccctcccctcccctcccctcctttttcttctttctttctctctccgcctctctcacactcgctctgttgcccaggctggagtgcagctgtgtgatcttggctcactgcatccttctccccctgagttcaagcaattctcctacctcagcctccctagtagctgggagtgcactaccatgcccaagctaatttttgtatttttagtagagatggggtttcgccatgttggccaggctggtctcgaactcctgacctcaaatgatctgtgcacctcagcctcccaaagtgctgggattacagacgtgagccaccgcacccggctgacatctatatttattgacagtggcaaaaaatttacattatgaaatggcatgcaaagtatgatcctatttttataaaataatgcatatacgatatatgtgaatatacttacctaatcactctgtgcctcgttttcttcatctgtaaaatgtagataatgatagtactgacctcagaggcttgttgcaaggtttgagtaaaattagacattgaagcacgaggaacaatgcctagcacatagagaagcactgaataaacgtagctattagtattattgttatattcaaaacaacattcccaaaggatgttgtatgttgataacatatgtttatatataatgcgtatatgtgtgtataatattaagagtgctagatgggcacactggctcacacctgtaatcctagtgactcaggaggctgaggtgggaggatcatttgagcccaggagttcgaggctgggcaacatagccagacccctgtctcttaaaaaaaataataaaattagctgggcatggtggtgtgtgcctgtagtcctagctacttgtgagtctgaggcaagaggattgcttaaacccaggagtttggggttacagtgagctatgatcgcgccactgcactccagcgtgggtgacagagtgagaccctgttttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttgcgtatctcagattctctgtctgctagatcattaaaattaggatgggctagagattagactttaattcccacttgcatttaattcctatcttcttaagtattattccctgaactttgattataatgtgttttctttaaagtgaaattttgaagaatatatgtatatagtcttacactagatatttgcctgtacatccacatatatctatatatttcatattatctttataattttggggaggcctaagtgcctactctgaattttctgaactgtaaattaaaatagctgctatgttgcgtgtgaaatgtatctcaggttgttgatactggagttctcttttgctgccattaagaagatgaatcactagagggacttaaatttcaagtaaagctaattaatttgcattgaaattgcaaggatttgtggtcatgatttttctgattttgaacatgctgaatctttgttcttttatttaaaataatctttatacttctcatggatttaaaaacaaatggatgggagaattacttatgaattatgagctttgaaatggaaggtcttgcctctgacatttaaaacaattagattatgatgcgcatcttggtaggcaggggctctttccctctctactgtgtgcctcttttttctgtcagcatgcatgtccttgagttcatttctttcttccttctgttcttctgtcttctctctactatatgtctctttttcttacaagatatataaaaatgatttgttacgtttggtggtctctgcctgtagtctcagctactttagggagaccaaggcgagaggattccttgagcccaggagttcaagtccagcctgggcgacatagtgagacccccatctcttaaagaaatggtttgttgtatttaaactgggatttggatatttcctctttgtaactgaaaaagtagggcaaatgaagggatgaataagtgaagcagagaggatttttaaggcagtgaaactactccatatactactgcagtggtggatacatgccattatatatttgtcaaacaaaacccatagaatgtacagcacctagagtgaatcctaatgtatcctatggactttgggtgttatgatgtgtcattgtagggtcatcaattgtaacaaatgtaccactctggtgcctgatgttgatagtaggggaggctgagcctgtgttggggcagggagcacatgggaactgaactctataatttctgcttaattttgctgggaacctaaaactgctctgaaaaatagtttatttaaaaaagtaagatctatgaaatttttttttgtcaaaaaatatcctaagtgtagttcttttgcatttccgtggacctttaatttttctgcctgtcagtagtcctaatatttttttaaaaaaactttttgtcccatctcgataatttggaagcttgcattcccagctctcttgctgacttgttcggcataattatggagacttacagcaaatgagaattgaatacttcgaaggctttgaatgaaaggtgccaggtaaaagcaaagcaattttattgttagagtgggggattatgagtcagaaattttaaggtcagctgggcacggtggctcacgcctgtaatcccagcacttttggaggccaagatgggcagatcacttgaggtcaggagtttgagaccagcctggccaacatggcgaaaccccatctctactaaaaatacaaaaaaattagccaggcgtggtggcacacacctgtaatcccagctactcgggtggtggaggcaggagaaatgcttgaacctgggaggtggaggttgcagtgaaccactgcactccagcctgtgcaacagagcttgactctgtctcaaaacagaaaagaaattttaaggtctgctcttcactgtgtgaccctggaggcaaggcgctgatgaaatgagtatgtgaaccaccaaaatcatggtgaagaggtacctgctaaccaaattcagactttggagcagctgtgtttcctcaatgtggcccatatgtaaatcaaatttgggcaaatcacgtcatttcacatacacttggggaatctgatttttgaatgaactttattggaatcctttggaaaagcaaagcataattttgtaatgcaagtaaccatccactaatttatatttttttaaggcagggttttgtgaggtgggatttcagtttttgtaacacactgtcactcctctgccatttaaaatcagattatacctgggagagaaggataactctgggaagttgcattaactccttcagacctgaagaaggcatttagtcaattattgtttctgggaactaaataatacccttgtcactcaaaaaatttaaaatagcctttgtaagtggctcctcagtctctaagagaacatgactcattctttctttgtaacttgaaagaaatccaagtgtcagaagacactgggaaatggacttaagttacacttctaaacatcagtactagagatcttaaatattaggaaaccaatatgatattggtttaaagttgatggttggagccactgtattaggatgaaagggcaagggattgactggcagtgctttctagaatattccttggggaaattcttgctggcagcattaaggctcctgagctctggctgtactctgtgtaccataggctgtcctgttcttttgtccagaaagcccactccctgcttttctaactgcctcatggttacacatggcctcataatgtttcttctgccagcttaatttatggttgctttcccctcaagcagcctttggatccatcttctgcatataaccagtgaaaagaaacggagtatattagaagatgccttgcattagtgctgggagatggattgcattcctgtacttcttaaaacccatgtccttgataatacaagatggagctgtggagggtgaggttctccatgtctgggttcgcctttgcctttcattgacctcggtggctgccagtcaatggaaaaatatgatcagggttcaccctatggaatcattgcttaatatcatagatgactcattggaattagtgttgttagaaaatcacttccagatgtggagcagaaacttttccaaaagagagaaatacactctggaaaactgggttttattatttttttaaatgatcttagggccagaattaaatctgcttgtgcgtggttagtcaacatatatttggagttctaagtagtacaatcctgttcacttcctttagactgacatccacataagtgggggctgcctttagcctgcttccttatcctctgtcaacttctgccctctccacatctcccatcttctcacagtgatgaatggcttggaagccttatctactccctcaggttccggtctctcattccttatcattaccagcaaaatttattgagcattcctagatactgtgaaggatggaagaaacatctagttggaaagcaatagaagttttggtcatatagctaagtgactgagaatgagctctggtgtccacttctgagttgaaatgccactttctggctgtggaatattgggaaacttactcaacctttttaagtcccagtttctttgtttataaaataggagtgatggtgataatcatacctaccgcataaggtaagcatgaggcctaaagggataatccatggtcaaccctttgcataggctaagtgttagctattattattcatcaattcacctccgtgtgtagtttttgtatgaagggggaacatgaaccattagttctagactgacactctccaaaaagcaaccacagtgtttgaattttggaattctctttaagtttatttcactgcagcagagaattcactggcttctcatattcactacatttttagttgtgccctgttaaaagagggaatgtgttgtcatctccttggaagcaccacatgacagactttgtagttcacgcaatagtcagaaggaaagtatttgtaaatagcataccctggagctcttgcaaaagccacgtctattctaataaggtgtttttggtaaatgaaatcttatgttttccatcctacttatttttcacaacgtaacctattatcacattgtatttgagtagttttctattgaatatgtattctcccctccctccatctcaaatgtaacatatcaataagtgtgtttctatactagaatgtggtaaaaaaaacatttctaaaacttgaaaactgcactagaagaagaaaatatcataaccattcctattacatagagatttacattaatatctttactctttaaagcattgaaaatgtttgggaattcacaaaactgctgcagaatctgctgtagtggttaagagcatgcacttggccaggctcattcctgtaatcccagcacttggggaggctgaggcaggcagatcacttgaggccaggagtttgagaacagccctgccaacaaagcaaaaccccgtctctactaaaaatacaaaaatttagctgggtgtggtggcgggcacctgtagtcccagctactcaggaagctgaggcaggagaattgcttgaacccagggggcggaggttgcaatgagtgatattgcaccactgcactccagcctggggtcagagtgagactttgtctaaaaaaaaaaagcatgcactccagagttaaatagagcctggctttgaatcctgactatactggttttctgttgctgcatagcaaattaccacatacttagcagcttaaaataacacacttattatttcacagtcagaagtgtaggcatggctcagctggattctctgctcagggttttacaggtgttggcaggactgcattcttatccagaagctcagagcttttccaagctcattcaagatagcacaatttggttccttgaagtagttgaaatggtcccattcagctgggggttgctgtcacctcctagaggacatcctcaggtcctggacagataggcctctcatcatatggcagtttacttctttaaatccagcaggtgtatctctctcttcaggatgggcccagttcctcttctagagatcacttgattaggtcgggcccacctggaatcctctctgttttgattaactcacagtcagttgattcctgacctaatcagggtagggatatctctcaatattcacaggtcccgcttacattcaagaggagaattaaacagggtgagtagaccaggaggcaagaattctaggggcatctcagaatttggcgtactacgctgactctatttgctcacttgggcaagtttctgacctctcttaatctgttttcccattgataaaatgtgagtagtgatagtattctctacctcatacagtcattgctaaaattaaatgaggtaacgcatgtaatgcatttcgcatagtacctggtgcttagcaagctttcaataaatgttagaagcataatagagaagagttacatttcttcctcctgtcctacattttctttcatttccccaccctcataatgaaatggctttgagggtaggacatatggtcacatgctaaagaagttgagtttttgcccttaggatttgaattaaatacaaaaaagaacttactgagcataaaggttgtttaacattgaaatttctaagccatttgtatgtctaggtggagacctttctagaaatatccttctcattggattcttggttaaatgaatgcatgtgcagcaggcagttcatggggttttaggtgtgcttcctaggtaagaagattttaggttatttactctgcttatgaaaagacagtttggtaggttggtgatctgtaattgtcaatacctttcaaaaacaaatcagtactttgtagagcgagaaatttcagtttacaggacctgcactgtgcactgtgtttctcacgtttagtaaggatattcaacagttcagcctcacgatagtcctgaaatttggactgagtttattcacataagctactgagacacagccatttctagaggatttgagtatagttccggggctattcctagaagaaaatgaatatgtattgctttttctcattgcctgtgtaaattgatcatactcaataatacttagaaaacaaactcccatgtgacaaatagttggttcgaaggcccattttgcaggggggactgaagagaaaggaaataaggggcagagagacaagaaggggagtttgatcctccgagatggaactgaacttgggtgtcacttttcacaataattactcaagcattcctctccattcagtagtgacaaatctgcatgtttgtcttctatgtgagaagtttggaagtttgagtgtgtagttaagaaccagccagaaacagagagctggtagggctgaggaatcgtataagcctgtaagatctatgtcctccccaccctgcctgtttgcccttgctgggctcactaccacacccagatgagtttcctttctgtgactgtcattagtacacaagtgccccaccgcattagctgcctaaaaaggagccaagttgggggacgattgatgagtttgtgacctcattgagaatacctcagttcttgttccttcacccacagaagggtaaaaaggaggtattaggcgtaccttctccatccatatttcaggctgtctgtttgctccctaaaaattcaacccataccttctttaaaaaataaagttgattacattaactttatttgtcggtgtcctctgatttttttctcaaatcagaggacactaacaggagagtaaaaaggcaacccacagaatgggcaaaagtatttgtaaagcatatatctgataagagattaatgtccagaatagataaagaactcctataatgcaacaacaacaacaaacttgatttaagtcaggcaaaggacttaaatagacatttctttgaagatgataaacaaatggccaataagcacgggaaaagatactcaaaaccattagtcatcagggaaatacaaatgaaaaccacaacgagataccacctcacacctgttctgatggttgttattcaaaaaactggaaaataagtgttgaggaacacgggcggggcggacctggaacccttgtgcattgctggtgggtaatgtaaaatggtacaaccactatggaaaacagttaagtggttcctcagaaagttaaatatagaattaccatataatagactgggagaggtggctcacacctgtaatgccagcattttgggagaggcaggcagatcacatgaggtcaggagtttgagacaagcctggccaacatggtaaaaccccatctctactaaaaaatatgaaaattagctgggcgtggtggcgtgtgcctgtaatctcagctactcaggaggctgaggcaggagaatcacttgaacccaggaggcggaggttgcagtgagccaaaatagcgccactgcactccagtctgggtgacagagcgagactctgtctcaaaaaaaaaaaaaagtattaccatataacccagcaattctattaggtggaattgggaaattctccccaaaagaattgaaggaagggactcagatacttgtttcacaccactgttcatagcagcattgttcacaattgtcaaaaggtggaaacagcccagtgtccctcagcagatgaccaatggaatattattcagccttaaaaaggaaggaaattatgacacatgctacaatatgcatgaagcttgaggacattatactaagtgaaagaagccagtcacagaaagacaaattttatatgattccacatatatgaggtacctagaataggcaagtacatagagacagaaaatagaataaaggttaccagggatgggcgggggcggtgtggaggaagtgcagagttgaatgcgtacagagtttctctttgggatgatgaggaagtttggaaatgggtaatgatgatgattgcagagtaatgtgaatatagttaatgccaaatgcagacacttatatagtatatacttaacgaagtatatactttaaaatagttaaaatggtaaattttatgtatatttttaccacaataactaaaaaaaccaaattaagttgattgtatgttttggattataccagcggtacttgtttgtgctagaaaactctgggggaaaacagaaaaggaaaaaaaaagaaaaagaacgtaacacctccatttggaatacataaatctttaatgttttgatttgaccatgtttctttttaactaccctccccttgtcagcaaaaatgacaatcactttctaccacttcccgtataggtggcaaaatagtgcctacttattccctgtgaaatttccatgtcttaattcacaaacagaaaagaaagaagaaagacctgagcagtgaaaaacatcgcttccctgctgggcattctgttgtaaacctatccttagcaaggcggtagttcccaggccatgacatcttgggagcagctaccaagacaagcacaaggacctggggtcagcaggtctggcttccagctccagtcgtatgaaagatatgagccagggctttcaagtcttcagtcattctcacatcccttactaagccacagagcaacatcacatttagccatattgaatcaagtcctcctcataccgagcatggctcttgcttcagagatgtgaaggctgttatctcttgtttcctctctcagctagctgttctgtcaatggtctgtccccagggcccttcaaaaggaactctggccaagggtccctgagggagagaaagatgccagagttttacaagggctgcctttgcctgtttgtccgatgactacttgcttacagtctgaacgtgagtgctctcaggttgtggtgtttatgagaaagcaggggccagcccctgacctggccagagactgtagtttctacagtagtgccagtacattcctgggttctgggaaactttactgagctaggcccagattgctccctaagagaaacctcccaagggtcagaggaaagaggaaaaggctcattgatttaacagaggacagagtgactgatagagaaaaccattaaacatttcaattggcttttccttgaattttagaaagggacttatttgttttcccactggaaaatgggatattatttaaatatgggatgaaaattacattggaaggactggacttaaatggccagaagtccttcattgatccaagcaataatcctgttttgccagaattctctcaatagtgaaatatgtaagcagcagtgaagtaattacaccaatcttcctccttaaacacgatgggactccaaaaacatataagtgatgtcctttgaattgtcacccaccacaggaggccacataatcactccctaatgttttcattgctctaaaacccaggaatttccatctgtaagtttatgattcgtgtgagatacccagggcctttactatatagttgtatttcatgtactgtatatacttttatcattagatgagtgtctgcattttggtagtaaaggaaaactaccatttaaacaaaacaacttctactggttttattgtgtctctccaagactataattacatctgctttttttcccaattgatatagatccagtcattttacgtgaaaagatactctttcttaggctggggcttcacatagcctgttgaaatccttagaatttttaaacaccttgtgtgaaaacttagttaagaatttccctctcttacttttggagcaacaaatatttgttggtggatacatcttggaaatcaaagaggtttttgaactctggtccgaggttccttgtagtcagaaatttctcttatattactgggaacaccgtaactgctagaaatcaacttaatcagcagtatgaatccattttggaagaagaaaaaaatgaaaagagatggagaacatcaaaatgttaacagtggtcatttatggatggtggttttccaagtgacttatattttcctcattatatttttggattaaaaattcttcaacaaacatgtattgtttttataattatacaaaaccaatacatcttatatgatgacaaggcaacctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgcctggctgatttttttggtatttttagtagagatggggtttcaccatgctcaccaggcaggtctcaaactcctgaccttgtgatccgcctgccttggcctcccaaagtgctgggattacaggcgtgagccaccacgcccgaccacccatactattttctacctcccagcatttcttcgtggggtgccttgttctatgaaaacttcatatatggcattgtgaatttacaaaaagataaattagtgagtgatgattcatactattaaaagtgttcagtagcagagctcctttggacagctaccctaatgtttgcctttcagtgttttagagattgtggtcatctaggaaagattgtaagaggcagaaaatcttaattctgaaggttaggaaaatattgaccatggatttgtactttgctcatttgaagagctagggacagagcagtgaataagacaacgacactacaatcacagaactttcatttaagagggtagagagacagaaaaggaaacatcaggcactgcaccttggcacctctgaaatgggctgggatggcgaaggaagcgtaggaaatagaatagctctgggtttcagaaggtgcactgaataggaagaagtggtcacctgtacttgggtagataaggcagcctcttggggtcttgaggtggggggagtagacataaccaggcagagaggtcaggatcatcaaatatgagataacatgacccattaggaggtctacccaccctgattggaggacatggggctggaggctgaagatggagaccagatcacaagggatctaataagccttgctgaacagtttgagctttattctacagactctggtgagccactgaagggattgaaacaaagaaatactgtgatccaacatatttctcatcaaaagttggaccattttggatcaaattagccataggaaaggtgttgggaacaaattaagtacagattggcagctgatcttttccaaatgaaatattctggttaatctctgtcacacaaggacaatgcaaacattttctctctcttaaagaaaggcttttcacataagcagagtcctcactttattttcctcaatagttttgtatgcaactctaatgagtagttttccataattcagtgtattactcctggaaaacatagacaataggacaaatttttagcctatgctgtcattttatggattaatttccattaacgttgaccttctggctttcagtggataaatgtgagtaaaacatctgttcatgtcattcccttgcttaaaaaccacttctggctccccatcacctacactaggaaacagtctaaactcattgacttggcatatgtggtcctccataaacgttccttcccagctcatcttggccattcctccctgttctgtacaccccagaatcaatgaacacatggctttcttcttctttgctaagacttatgctctcttccttgcctgccatggggatttttatttcatccttcgagtctcagctcaaaagctatttcctctctgaactgccttcaccagtgatatgaatcactcccttccctgtgtctgcatggcactctctgtatcccctaccctagcccttactccattgcatcatagctcttgatttagggatctctctctccctctagcccatgagtttgttaagggcagggcccacatcttgcctgcttttgccttcccagctttgtagctccactgcctgacacatggttaatgctcagtgaatctatagaactaagttctatgttttctatttctgtttataagattccagaagagccctcggggaatgacagagcagcaagcctcacttttgtagcaggctggtctgtgaaatatatggctatggtgtaggaacctcaagcattgaaaactaaccattggaatgaagagcaacatgatttctgtactgagaactcatctcttactaaatattggagattttgttgttattgttgttgttgttttgtttcgttttgtttttggatgtataaggaagtgaggttgggtgcagtggctcatgctggtaatcccagcactttgggagtcaggcaggagggttgcttgaggccaggagtttgagaccagtctgggcaacatagggagacttcatctctacaaaaataaaaaagaaatagccaggtatggtggtggatgactgtggtcccagctactcaggagactgaggtgggaggatcccttaagcccaggaggttcggggctgcagtgagccatatactcaaaaaaaaaaaaaaaaaaaaaaaaaaaaaaaaaaaaaaacaggaagtgaagctgagtaattttatgttttacttttcttgacagcctttgagatataatcctcattctatacagcttaaccatttgaagtgtgtatatatatatatatatatattgtttttttgaaacagagtcttgctttgttgcccaggctggagtgcaatggtgccatcttggctcactgcaacctccgcctcccaagttcaagtgattctcctgcctcagcctcccgagtagctgggattacaggcgcccgccaccacatctggctaactttttgtatttttagtagaggtggggtttcaccatgatggccaggcaggtctcgaactcctgacctcaggtgatccgcccgcatcagcctcccaaagtgctgtgattagaggtgttagccaccacacccagctgaagtgtatattttcatttttagtatattcaaagatatgtgaagtcatcgccacaattttagaacattttcatcacttcaaggttatttgtttaagacagtcaaaaaacctttcatagaggtcaactcttaagacttcttttaaatggtatctctggtgatagggggtttgtcatagggaagggaattggcttaaagaagaatataaagattatagataggggcaggcttttttgtttcagaggaggatgtgtaataaaaaaaaaaaaagctgaacacccaagggatggtttaacggatgctggtctgacttaacaccctttctaaggatagagagaggctaagctattggagctttcatacggtgagaccctataaagttatagaacatggacaggaaagtgagacatgggtttctagagagacaagaattgggaaaataattacaacttattaataggagagtatgctgtaagcttaattgaacttgactgaagctacacgagagcaactgaggaccaggatgtgttagggccaatagaacggtaaaattcagggcatgatcaggaagggctttttggcaggcatctgtagacacctgcctcacctcaccaagaaaacccagttgaagaaggtgtgccggccgggcggggtggctcacacctgtaatcccagcactttgggaggccgaggcgggtggatcacgaggtcaggagatcgagaccatcctggctaacatggtgaaaccccgtctctactaaaaaatacaaaaaattagtcaggcgtggtggtgggcgcctgtagccccagctactcgggaggctgaggcaggagaatggcgtgaatccgggaggcggagcttgcagtgagccgagatcgcgccactgcaccccagcctgggcgacagagcgagactctgtctcaaaaaaaaaaaaaaaaaagaaggtgtgcctgtttagtcacgagtgggatacaggataaacgtaaatcacctcaccatatcctgaaatgttataccacaaggtggagcatctcctgacattttaaagataaagaggtaaactgaagtcaaaggagctatcactttatttactttacatagcttttatttatttatttgtttgtttgtttgtttgttgttattaatttttgagatggagattcgctcttgttgccctggctggagtgcaatgtcatggtctccgctcactgcaacctccgcctcccgggtttaagcgattctcccgcttcagccttctgagtagctgggattacaggcgcccatcaccacatctggctaatttttatatttttggtagagacagggtttcaccatgttggccgggctggtctctaactcctgatctcaggtgatctgcccaccacggcctcccaaagtgctgggattacaggcgtgagacaccacgcctggccttacatagcttttagaatatattatctcatgcagttgtataaacttaaaatattggtgggcccaaaaaaggtagagataatttcaattaatggatagattcaatgtgatggatggtggaaaactaaaatatttgtagaaaggtgtatttttgcccctatcaaggttgattttcaaactagagtctgtcagttttctttactccattatcaagagcaagttaatgagatgggtagaccgattgccagatccagtgtggaaaatgatgtgtggctgctttatagattactgagcttctctaatggagtaagtttatgctactgtgttcaaatgatacaaacaggacctctaggaggttatgttttattgaatgtaagtgatttagatggctaaatctacatacctatagaatgcctgtgcactttacagttttttctgcttaagaatgcaagttatgttagagttttgtttataaaactcaggaaaaagtcagagatgtctttttgttgttgttgttgttacaagtttaaggtgagcactaagatctgaggcaggttataaaatagttgataggcatagaatgagcacagtctaatttctccttgcaggaatgaattatttgcaataatttgtgtatgtctttgtgaactcgttaaattctttgatttgttagaaagtcattatgtatctccaaggcacatttctttttctttctgtcaataatggtgtactaaagaatagaaaaaaaattctaattttaaaaaggctctttgccattctagtctctcaattattcaagcccttcttttcatttcttaaacctcttttgtgttacttttgagtcatttaaatgcttattagcacagagtgagcacaaaaagccaggaggaattgaattcaaatcagctttcctacctgtcaacaagtttgtcgagtaaagttttggctaaattgagttttggggtagaaagttcatgaaaattctatttatccatttgtaggtaatcaaggttatttgcataatatttgaactggctgtaatgaaaaatgtttgttaatagagtgtgcactaatcatatagtgcatagtcttgtttgtttcttattgtttttaaagtaaattctttgtaagtttttaaaagtagctcttgagtttttgtaaatagttaaatagacttggaaaggggaaataattcggcagttaaaacaatttcttccctatgctaaaactctaagggaaaaaatgggttttatttttccttaatgtttctatgttagatttaaaggccttcgaaatcatattgtgctgattcttagaacattaagttgttgttcctaaattaaagctgggaagtgaaaatttaattctgaaagcatcagcaacaacttgtccttctctccttgtgtgctgccattttagcttggaaggcatacgtgtaagagcagtctctttgtactatttagctggttatccctacacaaaaacttctggctttgtagttctcagggctctctgctaggttgtgtggaggatattgaggtgaattagacatggtcccttgacaatagcgtactgttgtttttttttgtaatttgattcttaaccacttgaaattgaatctgccaactcctttcccccaagtaaaagacctaaggtgctaatccctactcactgatgacaaatgctaaattggaagcaacagcttaggaatgcaaagatccttatccaattacattacaagctctctaagccagtcatgttcagcatcatcagggcgataggaaggcaagatctcactttggtaagaatgatagcgtagtttgagtaagttttagaaaattctaaaatgcaaagttcattcaaggaaataaaatgtggtaggagctgagaaaatgatttgcttttgttaagttcaacgcataaaggtttatgtggatcatggttaagagcactggcttgggagtccatcagataaagatttgaatcccagctccacaaatatgtgacactggacctgcctaagcctcaatttcctcatctgtaaaatgggcataataaaataacctctcacaggattttggggagaattagatgagatcatagatataaaacgcttaaccgagtatacagcaatgcttaatgtaagtggtaacagaaagtacaaggcactgtttgctgaccgaaccggtgtttttgatcctgcctaggagactaagtaaaccacccaaaaagcagttaagtatccagggaatgttatatatgagtaaatgccacaatagatgggaaagacaataagggctgttggggagcgaggagggctatgctatcataagaatcaggtgagctaagtgtgggttggtaataaacatgacccactggtctcatggaaagtatgacttttcccttagccgtttactttaagaaaggtcagtgtcctgaatgcagtttgtatttagattcttatgccaagattttccccagaaaataatctttatgaaaagatgttcatgtctattttggcaagttgggttctgctagttaaaaagatgcccctcccgccccaccacatcaccattagattgtagttatgcaaagctccttcagtaattggagttcctattggggaagagacaaagagatgagctgctgaaagatggtcacatttggaacaaacaggccatggtcataacaaagtcaaatactctttatttgaaccttatgaagaaatttcttacaggctggacacagtggctcatgccagcactttgggaggcttgatgggtggatcacttgacctcaggagtttgagaccagcctgggcaacacggcaaaaccccgtctctataaaaaatacaaaaattagcctgatgtggtggcacacatgtgtagtcccagctacttgggaggctgaggtgggaggattgcctgagcccagggaggttgaggctgcagtgagctgtgatcaaactactacactccatcctgggcgacagagtaagaccttgtctcaaaaaaaaaaaaatccttacagttatggttccattattgacatgctgtatagggttcctctctagaagtctctaatctacagtggtggcatctctcacttctgtgaatcataatgcaacttttgcttctcctcatattcacacaccactcttgacagttacctagtctctgatcttacagggtttatgaataaaactagaaggcaagatgaaatgatctgagaccacataaatcgatatgatgaaattcttctgattgatctaatggggaatagagggactcacacattttagtgtgcaaacacacttgtacagttccttttttggaagaagatatggctatcaaagggcatgatagatgcacagaaattacaatagtctgtgatcagctctcacatcttgggtttatctaccttccccacgagactgtgaacttctcaagggcaaggtctgtttttttattcacctctgcattaccaggggctagcacagggccagaacctcagtaggaactcaataaatgcatctttatgctgaactcactttgttttctgtgctgccggaaattgcatgcccccagtggccattttgagtgcaaagtgttattttaagatgctctctagagaaagcactctaggctctgcttacaaatgtctgagaggaaaggagagccgaatgactaggggatctggagaaattcctaagtgaaggtcgtggagaaatgatgggaaggagagactcacctctttttgagtgtgctacttctatcccaagactgttgttatttttcataagaaaatgctcagatgtcattgaggctgtagtctgactgcaatactgcaaaaaagcacttttgggctaatcattctctttctgaaaccagtagttgccatgttcctccttgtgctgaaactcagtttggaggatggggtggtggtagtggtggcgtggtggtgcagggatgtttttgaattggctctgtgccctactgctcagctttctgcctgctttctggtatccctcccagtgtgataaaggagagattctatgatgccagtgttcacttcagacttgcagaagagacattcttagaattcttaaggagaactagtttctaaagtaaaagatttaccggtaaactaatgacctttggtatggtatttaagcagaagtaacccaggctcattttgcattgcttacagataaatattatgtgattattcttgtgtcttacacatttctaatgataacataaatatgcctgctagtcaaatgtgcttttggatacatgagtggttggatggttgaatatatacattcatgtacatttttatgtattttagtattacaagcatggttttatatttatacacatacagttacgatgataaaagatcagtcatcctgtactgcgaatgtacaggaaccaccacaaaattgtaaagtctaagtggtgatgctattagtgaccctcagtgaggatccattgtttcctctctttggaccaagaagtggactgcaactgaatctattctgacgagtttccttttttgctatctgtcctttccacttatattagaaataaaattatctcaatttatggagctgtgcatttcttcccatttgtagagtttgcacatagaaagctcattgagatttggtccttagtggcctgagtaagcaacggaaaagtgtactgcatcccacaccatggtaccaaaattggcatttttattttactagagatagaaaaatgcaatttattctcctttatgggatgatatgaagctttctttttcaataaatgttttcaatgaagaagatatttgatttgaagaaaaatatgaagtaaatgataatacagatggtgtggcaaatatgaggattatatgtgaataagttcgggaaactaatagaaacaaggattaggagttgggagacctgggtttgaatcctggttcagctcctaatgtagacagatgaacttaggcctctgagccagtttcctgatggataaagttgaaatgatggtattttccttgtctacttgacaaagcgtttggtaacaaacagaatgcatatgaaagtgttttcttaagactgcaaagtgaccttgaaatgaattaacaaaaaatactaatattattagcaagttattcaagaaaacttaggagtcagtgaatgaaaacttttaagaacaaatcattttgttttgttttgttttccccatggtgaaaactgagttggttccaaatttaggttgacggttttcctgtcactacttacgggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctcacttatatgtgaaatctaaaacaatcaaactcatagaagcagggtagaatggtggttaccaggggctgggggcaaagtgggggagatggtagtcaatggtgggatacaaagtctcagttaaacaggaagaataagtttggtttttttgagatcaatagtatagcatgctgaatatgcctaataattgagtactgtacatcttatcactaagaataaatttctcatgttctcatcacaagaaatgttaaatatttgaggtgatagatataactagcttaatttcatcattctacattgtattaaaaatcataacaccactttgtaccccataaattaaaaaaataagtgattcattttgacatattctttccatattaatttggagctacattagaaagctgaaggagggccaggcatggtggctcatgcctgtaattccagtactttgggaggtcaaggcggggggatcacctgagctcaggagttcgagaccagcctggccaacatggtgaaaccctgtctctactaaaaatacaaagattagctgggtgtggtggcaggcacctgtaatcccacctactcgggaggctgaggcaggagaatcgcttgaacccaggaggtggaggttgcagtgagctgagatcacgccattgcactccagcctgggcaacaagagcaaaactccatctcaaaaaaaaaaaaaaaaaaaaaaaaaggaaaagaaaagaaaaaagaaagctgaaggaggattttcttttttttctttttcaaatatacttgaagtaggtacttgtaaaattattgtacagagaagttgacagattcaacaggttaaaacattgaaatttgaggactgtttttgcaatctgtactaggaaaatagttggcaccaaaagcaagacttagattatttttagtgcctcaagcttgctttcttagataggacttattcattcaacttctctgagaaattgatctcagactgtgagcgttagagctggaagatgcagtcagtttccttttgagtccatggaaacacggtagatatggccgaaaggggtcagatttttctgtcagaaaatctgaatttctcaaataggattttttccttttatttcaactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaagaaaagcagagcctttgcagtcacagacctgggtttgaattccagttctgaaggcaggcaagttacttaacctcagttaggtccagagtctctgcatctgtaaaatggggataatgattcaatctgtttcatattgctatgagtgttacatgaaaaaatgtacagaaagcgcttagcacagtgcctggcatatagaaagggctcagtaaatgtgaactgttaccactactcttattatgttacatcctggctttcttagcatcactgaccctgcttcttgttactttagcttcagtctgggtcctactgtcaatggccagctcgcctagaagtccagcagggatccactgactttgtcaccttgaacctaaccctttcataacctgcccaagggatcaagcatctctagtatctatgcctgccctggatatgctggaacttagtatgcccatgggacagtgtccctggtacagagtaggaacatgaatgttgatactttctcctccaacgttgcccagagagtagtacagatgcagtaaataccaacaggcacacttccaagtatgccactttttgttttacttaaaattcaataatttttagaaggcacacagattaagtagaataacacagttctatttctccagaactttttttttttttttggagagacaggatcttgctctgttgcccagatataagtggcacaatcacggatcactacaacctcaacctcccaggctcaagtgatcctcctgcctcagcctcccgagtggctgggactacaggcatgggctatcacacccagctaatttttgtactttttgttgagatggggttttctcatgttgcccaggctgatctctaattcctgggctcaagtcatccaccttcctcagcctcccaaagtactgggattacaggcatgagccaccatgcccagccagaactctttatctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagacacagttaacccataaaggaagatcccagtactagtaattgccaaatggttttagaaagcctgtcggcatagtaccagagttttaaaaagtggatatatatgtacttttcctatatttcaaattcaagattcctattttctttcagtgtattaaaacctatagcacagattggcacgtggtaaactacaagtatgaggacttctctggggactttcgaatgttgccatggtaagtttagcattccagggaaacatgcaacaggagaattattaagcttttttaccttgttaaaaccacttgtgaggccgggtgcagtggctcacgcctgtaatcccagcactttgggaggccgaggcgggcagatcacaaggtcaggagatcgagaccatcctggctaacacggtgaaaccctgtctctactaaaaatacaaaaaattagccgggcgtggtggcaggcgcctgtagtctcagctacttgggagggtgaggcaggacaatgttgtaaacccgggaggcggaggttgcagtgagcggagatcatgccatcacactccagcttgggcgacagatagagactccatctcaaaacaaacaaacaccacttgtgaaacctttcagttataatttgtaataaagcaaatcttcaaggaacctgcatgtttggttaaatgcagtgttttggttaattgaataggttttaactttcctctttgaaattccaaaatgtatgagagctcactttttggctttagtgaacctgtattgatcataaactaaaatatagctgatgatggataatgtagtgagcattttccagtagtgtcagtgaaaaagcttgatgataattagttcagtttgatgaacctagccatcccttggaaaaagtgcatctctttcagttgaattgaaggaatggcatgagcacactggcccaggagccagactgttggggctcaaatcttatttctaccacttactagctggatgaccatggctcagtcacttaacctgtttgagctctccattttctcatctctagcactaattcctcacaggatgtcatatgggaaatgtttttggaacaaatagcagaggaataagacatttgtttagccttttgtagttttcagagcactttccaaaagaggagaaaactgagtcctatatgacagcctggtccttgggaaaaaaaaagaaaaagaaaaagaaaacagagtcctaaaatgaccagtccaaggtcatacagcaaacaaatgcaagagccagaattacactgttgcttttttttttttttttttttttttttttttttgagacagagtttcgctcttgtcacccaggctggagtgcagtggcgcgatctcggctcactgcaacctctgcctcccgggttcaggtgattcttctgcctcagcctcctgagtagctgggcttacaggcacccgccatcacccccagttaattttttttttttttttaatttttggtagagacggggtttcacccttttggccaggctggtcttgaactcctgacctcaggtgatccacccgcctctgcctcccaaagtgttgggattacaggtttgagccaccacgcctggcctgtgttgctttttgacccggggaaggagaagttctgccaccactaacagctctggcacaggttccttagcaacttctgccctccctaagtttctgggcttagttatgtcttcgctgctggccacatatgtggaagtccttacagaaacacaaacttacagtaagtttactcagaggggataatctgaatttggaaaggagaataggatgtcttggcattttctcgtttgtgaaagaaagaaatctgctcatcttgcttttactgttgttgtcattattgttgtgtttttgtgttgtttttctttttttttttggtctttttagtgtctaagacagttctcttatatttgcagtaaatctttgagaccagaaaagattcctaatcatgtatttgagatagatgaagactgtgagaaagatgaggtaagaatgggggcaacagttggggtaactgtgctagtttcctcacggtcactttgctgaaaaagatttcaaagggaatttcttgagaaaatatgaaggaaataattattctggaatgatctgtggccagctttcaaaccgggtgcttttcaattttttttttaattactgtatttccaagtagggtttaggaaaaaaaatcaagtgagaggggctatgatttgtacataaacatgttcccccacctgtgggacatgcttgtggagttgcttttcttgagttgggcatgtggtgtggtgattcatctggactctcctgcctgatagattcctcttgggacagatggcccggatgtctgtgacatttcgaggtgcagttcgactgtttacataatgcagaagatttcccagaagagagcccataccattcagtaaatactgagtgcctactgtgtgcatagcacagagcctttcattctacagtcaactattttaaatcctcacggggaagaggggactttatgttttaattaggaaatgggcagggcctcattctgtgcccctaaatgtttcgctaattagatggcaggctggctgttgttttactgataatttttgttctatttcaggactcatcttctttatgttctcagaagggtggtgtgataaaacaaggctggttgcataaagcaaatgtaaatagtaccatcacagtaaccatgaaggtaggaagtagttattatattattccatcattttaatgatattggcataagtagtctatctggaaacaatatttattttacaaagagccctagcaaaaaaaaaaaaaaaaaaaaaggagaggattctcacagacgtatggaatttaaaaaatctaaaacatcaggataaatttagaagtgcaactttttaaagacatataatgtaatgattatctggtgaatcaggatgtttaaaaaggaggctgtcagttgaaggaggaaaatagctttgaaaaatgggcatcaaagtttcatatgtagaaatgaccttaatgagtggaaggacaagtaatccatttctttagcaaatattaattaggtacttattacatattagtcactgtggggaaatatgtagatatctaagatgtggtccttggtctcagcctctagactagacaagaaatatactattttaactagtatacaaagcagtcctttagtgcagtgagaacagtctaactagaaagttttgtagtttgacaggatagtgagtttgcataaggggtttaagtgagctaaaagttgaaacgttgaaaaggataaaattgggctgggtgcagtagctcacacctgtagtccctccttctttgggaggccgaggtgggtggattgcttgagggcaggagttcgagaccagcctgtgcaacatgatgaaaccccatctctacaaaaactacaaaaattagcctggcgtgatagcacacacctgtagtcccagctactcaggagactgaggtgggagaatcccttgatcccaggagatggaggttgcagtgagccaagatggcactactgcattccagcctgggcaacagagggagagtgtatctcaaaaataaatagataattttttttttttttacaaaaaaggataaaattgtgcagagccttgaacaccttggacatgaggttcacttatttgggaggctgtaaagagccattaaaatccaaagggaaaacaagctacatgaggattctgagcagaaaaacaaattatgctctgataccaaatataactgttctttcagatattcaatataaaatcatgtggttttctgaggatgattcacacttgcattaagtattgaaggtcattctatctttcacacaggctgcaagtagaaaccgtgggtatctaccaagggaagactcaaattttatcttaatttaatattttgcctgctgccttccctttggtgatcatgtcctgttctcactttcattttcaagccctgaaaataatgaatccaagttgtaggatacttcctgtatatcgcttgcacctaagcatgggcatcagcaagtggtgataataagagaaaccatttattaaggacttaatacgtaccagacaccatactgggtgttttatattctgtatcttgtttaattctcatggctgccctatgcaataggtactgctaactattcttagtttatagatttggaaagtgaagctcagagaaattcaataattaacccaaggtcccacagctccaagttttcagaggtaggatttgaacctaggcaggctgatgtcagagcctatgctcttaaccagtatactatcagtgctcactagctgaatgagactcaagggtttattaacaatatatttcgtgccagagttatcaggttcagaaatgtacgtgaaggttacatttctgtgtggattatcagaaaatggttgtatcgtttttgactgcattccctttcccgcagattctcaaaatattcaaatagggccaggcaggaggctcatacctgtaatcccagcactttgggaggccaaggcaggaggatcgcttgagcccaggagttcgaggctgcagtgagctatgatcacaccactgcactccagcctgggcaacagaattagatgctgtctctaaattaaataaataaatgcatgaaggaatgaatggttttaaccacatttaagccttagcctcacattaagtaaatgtgcaaaaatctggattcataaaataagatgttaggaaattaatatctttacagaataattcgccacagattcctttagtttaatacctttcaactttaatttgccttacaaacaacttctaattttgtaggagtccatatattataagccaaaaagcacatgctttacattttctctcataatttgtgaaatacacattgattgattgatgtgataggaggaattgatggcctctcaaagatgtccatgtcttaatccctggaaccagtcaatggtcccctacatggcaaagaggaattaaaattactaatcggcaggagggacggtatccacaattatgcgggtgggcccagtgcaatttcaagaaccccataagtggaagagggaggcagaaaaggacagtcagggaaagagatgtaaggatagtcagggaaagagatgtgagaacagaaggagggccagagagagatgctgtcttgctggctttgagggtacagaaaagactcacaggccgagaaatgcaggcagcttctagaagccggaaaaggtaagaaaatggattctcccatgcagcatccagaaaggaacatagccctgctgacaccttgaatttagcccagtgagacccatgtcagacttctaacctgcgaaactataagataataaatttgtgctattttaagccatcaaatttgtgctaatttattacaacagcaataggaaactaatacaattagttaggcaaaggttgattgttcagcttgtgtgtttcttatccctgagcttggaaactctagcactaacagtgaccaggcgggagccataaattcatagagtgtgtgatgggtccgaggcaacctggtgaccacatagcccacagctgaaggggacagctgccacttgtctccagctaattgttgttttgctgcagctgagctaggctctttgctttgcctctttttatcctcagctgctcatattctgtgtgtgtgtgtgtgtgtgtgtgatcattaacatataaaactttttttttttttgagatggctcctagctctgttgcaccaggatggagtgcagaggtgcaatctcagctcactgcaacctccacctcccgggtttaagccattctcctgcctcagcctcctgtgtagctgggattacaggtgcacgccaccatgcctggctaatttttgtatttttattagagacggggtctcaccatgtggccaggctcgtctcgaactcctgatctcaagtgatccacctacctcagcctcccaaagtgctgggattacaggtgtgagccactgtgctcggcctatttctttctttttaaaatctctaccaaacatcaggcaaaggaaggaaaagaggaataaaccaagttaattggtcatatgaagctacacaacttttatgtttatttttatcatttatttatttgtttttgagacagtctcactgtgtcgcccaggctggagtgcagtggcgtgatcacggctcactgcagtctcaaactcccaggctcaagcagtcctcccacttcagcctcccaagtagctgggaccacaggcacatagcaccgtgcccagctaattttgtttgtttgtttgtttgtttttgatagagatggggtctccctatgttgtgcaggctggtctcaaactcttggactcaagtgatcctcccaccttgtcctcccaaaattctgagattacaggcatcagccaccatgcctggctactacacagcttaaaaaaagttaataggaaatactttgaaatgcaaaggccatattgaggtttgggagctgtttctggttatgagtttcctttatccccactcttttccattataaattatgaatctccattttgaatttcaaactcttctgatttcatctcctgagccatagcagtagtgttgtatttcagaatttgtcacagctagaatgggaatcagaggaaggttcagctagaaccttctgaggcattttgccaagattactttttcctctaataattgtattttgggccaggcgtggtagttcatgcctataatcccagcagtttgggaagccaatatgggaggatcacttgaacccaggagtttaagaccagcctaggcaacatagcgagaccctgtctctacaaaaatgaacaaaattagccatgtgaattggtgctcccctgtagtcccaggtacttgggacattgaagtaggaggatcacttcagcctgggaggtcgaggctgtagtgaggcgagattgagccactgcactccagcctgggtgacagagtgacaccttatctcaaaaaaaaaaagtgttttaactgttatttagttcaacattattgaaattagttggaactgcagtgttgacacatcattttttcatgttctctttctgtatcaatacagggcaagtgagtgtatggggcagaggattgaaaagggggagcagttttatagtttccaggctagaacttgaagtgaaggccaaagcacaagtccaggcctatgaacaaaggcacactgggagagtctggtttgtacctttcagtgctctgttacagggtgggggatcatataagttcttcctgcatcacgtctggattgtttcaggcataggaggctaaagctaaagatgaggtgagcagctgacccagctcttggataattggaaaaggcagaggcagaagaactgagacaaagggttgacagagtttgagaggaaagtttctatgtattttttttctactatggtaatgtttgaagtgaagaatactaatgaagctcataagcaaatgggaagatgactcaggtgtgctattatctgagtcatttccccaatcctggaggcaggtttatccttagagcatctggagttccctgcccgctaggaactccagcccacactggtaagaagcattggtagatttagcaaccagcacctcagggccagagcttgcagagttgagagcaaagaatcttttctttttggaaaatccaagcttcgatagcccctgcaaactcatggcaaactaactaggaagcaagagcagatctggttattaaccatgactcagtggcaaataacagcctccataagccaagcttcttccctgtgttttagctgagcttatttgatgccctgtggcttgacactggcctgcagttccctctggaattgctagggaataaaagcaaggcatcttggtgccttttagagagaggtgtacgtttaagcgtctttattcattaagaaatttctaaattttaaaaattatgtgctgggcatagtggctcatgcctgtaatcttagcactttgggaggccaaggcaggaagatggcttgagtttgggagttcgaaactagcctgggcaacatagcgagccctgtctcttcaaaaaataaaaaaattagctgggcatggtgacgcatgcctgtatttgcagctacttgagaagctgaggtgggaggatcgcttgagcctgggaggtcaaagctacagtgagctgtgattgcatgactgtactccagtctgactgacagagcaatactcgatctcttaaaaaaaaaattacagtcagttctttggaaagtttgaaattatgcgcaactttaaactgatcttagaaataggtctgagttgttttgctggacattttgactgttagaaataaaggaatctgcccaggcgttcatgaccagcctgagcaacatgacgaaacctcgcctctacaaaaaatacaaaggtagttagctaggcgtggtggtgcactcctatagtcccagctactctggaggcttaagtgggaggatcacctgagtttaagaggtggaggttgcagtgagccaagattgtgccactgcactccagcctgggtgacagagcgacactctgtctcaaaaaaaaaaaaaaagggagggagggaggactctaatagcaaggaagggaggaatcacatcgtgagagaaagtgcaaaaataaaacgaaggaaagagtattagaagagactcagcaaagtgcagttgataaaagggaattagaagattccaactttataagatcttttgagaaagcaaccacatggcctttaatgcaatctaaataatatagccaaactaatttgtatatgggttgctgtagacagtttaaccttcctagctagcttgccagcaagttttgcaagaacattcaagtcgacagttcttgcaatgacttgcagtgcattcaagtcgatgggctgtagggaaaagaggggctagtagaggaactaggctgagttcttcgtattggaagattataagaccacatatttataggataaaaatttatattttccccaatatatagctttccccctgctctggtcagttgttaagatataatctgtaccaccttctgaaatgggcatattttcccagaagtgcttgctgagtataacctcattgttggctgagaaacttgccctgaggagcctggactacaggaaagctgcgaataatgtgcatcactccacgagtcacagtgctctgtgcccaagcacttcctctcactgaagaggatgcatcatgcagttcttgcagaagctctgttgtactgggtgtggtggcatgtgcctgtaatcccagcaacttaagaggctgagtcaggaggatcgcttgagcccaggagtttgaagctgcagtgagctatgattgtgccactgcactccagcctgagcacaaagcgagacctcatccccttttttttttcaaaaagaaaaccccaaaaaacaaaaaaccaacgctctgttggttgtttgggtgcagtgaacatttagcacttgtaatttgctttgttcttggtattcaagttaaaacaggacaagccttatcatagtgattaatttcgtcaatttgtggtttctagttaatgaggaggtaccttgctgccactcttcaattcctggaaaagtattagagagaagttttaagatgtcatagagaatacatgatcctttagacagaaaccacaatcctaacagacccctattcatttacattctctctttcccaagtagctgctagagacatctgctttattcaacttcttttcatatcaatgaaggaatttaatgtgggtttagatagctgtgatattggacatagccttcccctggtatttagaactatttctcctaagagatataatgatatatggaggaatttaatcttcagggtggtttttcattttttaaaaaattgctgcagattcttggccaactcctgggacacccacctttatgcatctttttggctcaatttggtcacattcctctagctctctcctccccattctcagcaattaaacgctgaagtgccttgatatgatatcggggttgcaagttcaactggttgatgtatgactcacttctagtgccctttaaaatttttttggcacaaaaagagccatttgttatatatccagagtccaaaagtccttaaatccttaactcttccaggagggatttttcctcctctgcagtgggagaacatcaaatcaaatgaggatttgacctaagaaagcacatacaatattaaaataattgctaggaggtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgggagatgaagttgatttggttctttggtatcaccttgtgcctccatttctcttctgtaatatggagggcataacagtaatgaccacataaattgttactaggattcaatgaaataatacaaggaaagcacttaaccagagaccataatgcacaaagcaccccacagatgttagcaattgttgttattttatattattaggattgtgggagggccttgaatgcagtatctggcatgtgtgccttatgtgagtaattgagagtcattgattatttgagcagtgacatgctgtgctgaaatacatctgataaaataatttgtctgtaatgagaagggtggattgtagacccctcctactagacttggctttaaatcaaatagttgaactcttcagtgcccagatacggtagaattatttaagaaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttgaaaagaaaaaaaaaaaacaaaataaacttgataggactgtaaatgacatgatggagagaggtgagtgatatatcaggttgccaacgtagtggtaggggttctttagcaggatgaagttcctggcattctggtgtcattactgcaactcacttttctaagtcctgtggtttttttccccattgtttctttcatttttgtgcagaacagttctaagacccagtatgtctctgtctctcctgctttctccttttccttgctggctcttccattgtgttctgtctgagacattaggcaagttcccctacatcatttctacattgctcttggcctacctactctgcctctaaacctttgatgtatcctttctaagggcttctggttcatgcaatttagcagtaaataattacccctctaggtaacacacaataggtaaacgctcttgggatttgctgtataaaatgataaaaggttttcctactttcttttctttcttttttttttttttgacagaggatctcgctctgtcttccaggctggagtgcagtggtacaatctctgctcactgcaacctctgcctcctgggttcaagcacttctccagcctcagcctctcaagtagctgggattacaggtgtgcaccaccacgcccagctaatttttgtatttttagcagagatggggtttcaccatgttggccaggctggtctcgaactcctgacctcaggtgatccacccgcctcggcatcccaaagtactgggattacagatgtgagccgccacccccagccattttcctactttgaggatactaagtgctccaactttccttcctatgtttaatctttgatgcagctgaatgacaaaaggcctttgttcctgctccagaaggggttcaaaaaggttgtcatctggccaggcacggtagctcacacctgtaatcccaacactttgggagggtgaggtgggtagatcacttgaggccagaagttcaagaccagcctggccaacatggtgaaaccccatctctactaaaaataaaaataaaaaaaaattagccaggcgtggtggcatgcacctgtaatcccagctactcgggaggctgaggcaggagaattgcttgaatccgggaggcagaggttgcagtaagccgagatcacaccactgcactacagcctgggcaacagagcgtggctctgtctccggaaaaaaaaaaaaaaaaaagtgtgtcattccaacagcttggggccttaagcacacttggcaggacctgatcctatagaatcaaatcctttggcttgctctctgttttattgttgtgggtggtctgaatgggccactcttcaggatctgtgttcctcactgagtaaggtggggcattttcagctgtgttcaccatcaaacaaaaataataaagacgaggaggaggagaaagaagagtgtgggcattacagagaaacacaattctgttgtatgaaaccactggagaatctgctggagaatctttgctggaaatgggattattcattcattgtttattaattttgaaacattttattgagtccaggcattgttataggtactggggggttaacagcagtagatgaaacatgaaacttcatgggctagaaagagacggcaaataaaacagatagatgaataacatatttgtatagggatcactccatgaaaaagacataactgggtgctatgatgagggcaggtggtacagaaggcctcccagaggaggggagattgaagcaaagacgtgaaaggagtaagaaagtaaactgtgtggatagtgaggaaagaggattctaggctgaggaaacaggaagtacagagacccaaaggagcttacttgagatatttgagtaacagcagataagccagtgtagctggagcagaaagattagaaatagagtccaaggaaggccgggcgcggtggctcatgcctgtaatcccaacactttgggaggctgaggtgggtggatcacgaggtcagatcgagaccatcctggctaacatggtgaaaccccgtctctactaaaaatacaaaaattagccgggcatggtggcgggcgcccgtagtcccagctactcaggaggctgaggccggagaatggcgtgaacccaggaggtggagcttgcagtgagccgagatcgcgccactgtactccagcccgggagacagaatgagactctgtctcaaaaaaaaaaaaaaaaaaaaaaaaaaagagaagaaatagaatccaagaagtaatctgaggccaaatcctgtgcagttttctgggctatggtgaggattttagatcttactgtaaagtaagatgggaagccattggaggatttgggcaagattctctttgtagccattatcctattctgattccagttctatcagtgacttgcctgtgtgaaccttttttttttttttttgagacggagtcttgctgtctcgcccaggctggagtgcagtggtgtgatctcggctcactgcagcctccgcctcccgggtacaagtaattctcacctcagcctcccgagttgctgggattacaggggtgcgccaccacgcctggctaatttttgcatttttaatagagacacggtttcaccatgttggccaggctggtcttgaacttctgacttcagatgtttcacccacctcggcctcccaaagtgttgggattagaggcatgaaccaccgctcctggccgcctgtgtgaatttgaatgagctcttgatccctcagtttgctgttaggtaaaatgtggataatgatacttaccccaagaggcattaaaagaattagctattggttacaaaaggctcgcagccttcaaatgacaggtatgatatagagtaattaccattattctgtatagtcgttattttaacacctgtcttcttttagaaatgtaaaaaatatatataaacttataccctaagtagctgcattgtggaaattttttaaatgtctaggaagttatgtttctgatttccctttgatttccatgagagagatttaggatattcctttcttctttgcaaaagatatcttaaaagcttctcagaagttgaaacccaacatatatcataaaatattagaatgagaagagaccttacaatttgttgttgggcagagtctgatttctacatagagatgacttttaaaaatattccttactgtccaaactgtgtgtttctagtgtatgagaaatcacatggggagagtagcttccaggctaggaaggctgctgtgttatttgttcaagttgaatgaaattatttgtagattgtggaaaaatatgatcttacagatcatctcgtctgatgtcatcattttacaagtgagtaaactgagagaagcagagtcttgaggacaatttcactgctggttagcaggagatactggctgagaatcagtatcataagactttcaggcaactgctctttctgagtgctctttcaggcatcatattctctcctcagattcataagctacctaccctagtgtcacatttagatataattgcaatgttagaggaagtgatttgctgtaatttcatatccctttccatgtccattgtaatgatgcactttgctaatatgggaagtggtggctgccacagaatttctttgcttggtgaggcagctgtatgtgaaaaaaaaatttctcagactataatttgactgtatgccacaaatgttttgctctgtattttctcttcttctgcctctctctttgttgctggctgttgactctgcaagtggattctgtaggctgtcccactgaagcagcagaatttcagttttagatttgaacaattcaaatataaattttttcatattatttttttcatgttacttttggcctgaaagatgtattctagttttgttatagataattactgtgataactttaaaaagcaatgtgttatacaaagttagtgttcattacatgttattcatttgaaatgacctcagcatgtaattttaagccttctattcccatcattttaatgagagatgtgaaccattgtcatgaaaataagcaaataggccaggcagggtggctcacttttgggaggctgaggcagaaggatcccttgagctcaggagttcgagaccagcatgggcaacatagggagaccttgtgtctactaaaaataaaaataaaaataaagaaaataagcaaacatgcatatataatcaccattatgattaacattttcctttaatattaatctagatttcttccagcaaacttaaatgtagattaattgaatatgagaatatatgtatatattctcacatatatgagatatgtacatatatgaaagatataaatatacccacacattctctttctgttcctttgcatactaatacaataacatttaattgactggcattgcaaaacaagctgatgttttctgctaggactcttttctgttgatagcacgtagcccacatggccccttcccgagatagaagctgtagcatttatcagtctaacctgttagggtattccttacactgatatatatttttgtcattcattaaaaaaaatcaatgatatttatacaagtcaaaaataaatatcaatgttatttatttttactggtttttctaaaaagaaatgtcccttaaggcttttatatattttgcttggtcatgctatggagaaataaattgatgtttcaggtactttgccagacgttaagttgttggcaagaacgatcttgccaaataatactctttccataattaaagttctcaaaatgatcagggatcatattggataatcagatgggtaattaaaaatgaccagcttaaattttaaagccaggttcttcgaataagacaagatgcataggaatgcatttcctcaataatcaccaggagctgctcttcccatctcaccctgaagtgacttcagatctgtcatcctgggaaattgcaacttgaataagctctgcctttcactgtgacaattgcttgacatagcctgcagtttgtgacttactgaaagaagcatcaattcatcagagagctcctaatcccttttctcacctcttttatcagactgtcaaagtctgtttttaggggagaatagagggacagcatgaactcatcaggcagtccccaaccttttcctgttcctgtgggctttgctgtgagttgtagcaacaggctactccttaactattgtgaatccctaactccaaacaaatggcatagttccattaggcctgttgatttaaagctcagcacttggggcactcgacaacaactggcaggcaactaatgactctgtgcttccctgtgagtgccctgtaaattggactttcagaagcaaagacagtggtacagtgtagatgagtacatgtgtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctgaggtgggcaggtcacttgaggtcaggagttcgagactagcctaggcaacatggtgaaaccccgtctctactaaaaatacaaaaattagccaggtgtggtggcacgcacctgtaatcccagctacacaggaggctgaggcaggagaatcgcttgaacccaggagtcagaggttgcagtgagccaagacggtgccactacactgcagcctgggtgatggagtgagactccatcacaaaaaaaaaaaaaggaaagaaaatgaaccttggcatttttccatcttgattgatggcatctccgtcctccgaaacatctacactagaaagctcagaatcctcttcagtgccctgttcttgctcagtgccaatatttaaatgtttatcaagtctctttgagtctggctctaaagtgcctcttaacctcttacctcctactttcattgccctttctccagttctcccttttatcatcgctggcccaaagttgcgcttttatgcctcctgatttcttgtcttgctccagttcaacttcctaagatatagtttgggtcaatcatttgccttctccaaatcttttggctcttgatttattgtcttacagagtgaactctaaagcttttgccctgacattgaaggcccatagtgatttggcctcactgtgctttctagcctcatccttcctgaacccccttgtgtattctgtgctctggtcacaccaggctaagcattctaaagcgttgcacacatatatggcttgccttacatttttttcctcttcttgctatatataatttctccttctattcccgtttgaaccttatcttttatgactcagcttaaaggctactgccgtgaaaagttttgtgtttccttcctcaccctcgtgactaccaagtagaattaagctccacctctcctgtgctaaccattttgcttttccttctgtcatacaactaagtcacattctaattttggttaattctacacattcctttggggattacagggaccatctcttactcatttctgtttcttctataattaccagggttctgcacacagtagggacttaatgaatgtttgttgatatgaattactgaggggacacagacagaaacaggatgggaagtagagggctgagagatgatctggatgggaagtcaattgactatggaacagaagtcattattacagagccagggtggtgtggtggactagaagaacaatgggctgattaggaggaaagtgatgttagttcagcaccctcagtttacctaaatcttcattttcagaactgtgaagtgggattagtagtatctgtatactctatcaaacaagattgttgtgaggatcaaatgagaaaatacctttagggcatgatgttgtgtgcctgtagtgccagctactcaggagcctgtggcaggagcattgcttgggcccaggagtttgacgctgcagtgagatatgatcacgcctgtggaattagccagtgcactccagcctgggcagcacagtgagatctcatctctaaaaagataaattaaaaaattctaacaaatgagaaaacactttttaaaaagtataaagctctatgtgaataaaatgtgcttatatgtatgattatatattatatattcatatatatgaattcatatatattcatatatataaagaagagctttcttactggaagaacgaggcacacacaatttccggattgacctttctttgtagtgcttccctcatctttttatttttattatcatttaaaaaatttttttcttttcttttttttttttgagacagagtctcactatgttgcccaggctggagtgcagtggcgcaatctcagcttgctgcaacctccaccttctgggttcaggcgattctcctgcctagagtagctgggattagaggcacccgccaccatgcctggctaatttttgtatttttagtagagatgttgtataactttctccttagttcagttaaaaccagttcttgtcacataaccaggaaagattaggcttgtggacacatagaagggtgagaagtggaatttactgggtgaaaaggaaaaataactctcaccaaagtgagagagagtcctgctagcaggtttcccacctcacagattaaaggttttgccgggaatccttggctgtctcctgtctctgtcagagatggggtttctgcatgttggccaggctggtctcaaattcctgacctcaagtgatccgctcacctcagccacccaaagtgctgggattacaggcgtgagccgccatgctcaggcacctcatctatttatgataccgcctcccaaatattttcaaatgtataaatctttatgacttgatacagcagtttaatttcatcctttcgtagacttcaaagattagaaggaggaactttcttggttccttcttgaataatgaccatgcagtggaaaattattgattcatgagcatttcttgaaattaatgctgagggatttgaaaagggtagtatgtcatttcttttttcatgacagagaaggtggtaaagtaaaagaatgtatcagcaagcttgagaaaaggaggagacttattttccttgtgtggtggtattcagcacaggttacttccatgtattttatggagagtcacaatttaatgtgaaccaactatggttgcatggtcttattttttctttcttttttaccaagccattcttcttcttctttgcttgcttgctagctttctttctttctttctctttctttctttctgtttctttctctttctctctctctctttctctctttcgttctttccttctttcccttccttccttccttctttctttctttccttctttggagtcttgccctgtctggagtgcagtggcatgatcatatctcactgcagccttgcagccttgaactccttgctgcaggcaatccaccttagcctccaaagtgctgggattacatgcataaaccaccatgctggggcttctctttttaatttttaattttttttttgaggcaggatctcactgtgtcgccccggctggagtgtagtagtaccatcttggctcactgcacccttgaactccaaggcttaggtgatcctcccacctcagccccacgagtagctgggactacagccatgcgccatcacgcctggctatttttttttgtattttttttgtagagatgaggtttcaccgctttgctcaggctggtctcaaactcctgggcttaagcaatccgcccacctctgtctcccaaagtgctaggactacaggtgtgggccactgcccccatctttacttttttgttgctatggatatggaatatttctacatattttgggggtacatgtgatagtttgatacaagtatacaatgtgcaaatgatcgaatcagagtaattgggttatccatcacctcaagtgtgtatcatttaattgtgttaggaacattccaaatccactcttctagttatgttgaaatatacaataaattattgttaactatggtcgccctattgtgctgccaaacactgtggtcttcttttatactattgtgatacagttgatactatgcgtggtaaaatgagttaggatctatagtgccttttatggtgagatataaatttatcagatttgtttcaggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaaccagttttgaaattgtagagatgattgtcctgagtatcttaccacgatactgtattctgtagactctatattatagtagattagaaggttgtgacccatttattcatttaaatcattgccaaatctatttatatttttactttattcatcttactggacaaattagttacacaaatttggaagctccttttttttttctattttaaatttacccctcataaacttcaaagctatttttcaaaatttagggacacagtcatgatcctctaatctaggattttttttttttttttttgagacagagtctcactctatcgcccaggctggagtgcagtagcacgatctcacctcactgcaacctccgttgccgaggttcaagtgattctcctgcctcagcctcctgagtaactaggattacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacactttaaatggagggtggtgcaggaaggtgcaggtttatacgcggatgtgtattttaacctctttcatgagagttagatgtgttttgtagtaagatatatgcagttaatatttaagtctatgacattttctaattaagtttttaatttgtttaagtgggaaaggtctacagtatttaagtattacaaatatttttcctaatggaaaataccttttgaaaaaatgaaattgaggaagacgaaattttttggctttcttttccctttttctacatgagatttcgaatgaaaattttttatttagtttgaaatcggaaaatgtgcattacagttttttcttccacgaaaatatgaaataatttggggaagtctgattttgttgttgtcgttttttcttctttctttctttctctctctctcttctttctttctttctttcctttttttttttttttttttttttgagatggagttttgctcttgttgcccaggctggagtgcaatggcacgatctcggctcactgcaacctctgcctcctcaagcagttctcctgcctcagcctcccgagtagctgggattacaggcatgcaccaccacgcccgactaattttgtatttttagtagaaatggggtttctccacattggtcaggctggtctcgaactcccaacctcagatgatccacccgccttggcctctcaaagtgctgggattgcaggcgtgagccactgtgcacggcctctttttctttttttaagtgtagtcaagtacagtagtgacaaggggagaaagagtagaacaaaaagttcaatatgtaattgactgaacaatcaattgagataactcactacctttgggccagccattgttgtttttttctttttgcttcatatggttttctaattaaaaatttagtttaaaatagaaaaagtatataggctataaataatgcaaacattttccttaatgaaagtatcacacaagaaaatggaattatttggagaaaataaattttaaaaaataatttcatttccctttctccccccacggagttaaatattgctttagtgcaagttatgtgattttttttttttttgtaaaaaagtaacagtataatgggcctcagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactctgttcataagttaaacgtaggtagtccatggggttccagccttttgtgcctctcaacctaaatgctgctgactcccacgtccagatctctaagtcaggcctctcccatttttccaactacctactaccgtcaccacaaacacaacacatcccatactgaactcaccatttctactcactgtaccccaaaatctgccattcatttgtatttcacgactaagttcataacatcgttatctattgaatctcccaaattagagaccactgtgttaatcttttttttttttttctgagacaggatctcactctgtcacccaggtcggagtgcagtggcaccatcatagctcactgcagtcttgaactcttgggctcaagccatcctcccacctcagcctcccgaataaccaggattacagacctgcaccaccatgcctggctagtttttattttttatagagacaagggtctcactgtcttgcctaggctggtctcgaactcctggcctcaagcgaaattccctcctcggtctacatattagttttgatgcttcccatacccattcctgtcaattttgcatcctgcacagctcaaaaacgaaaccaaatttcgactgtcctggaacatatattgtgtggggaagacaaagaataaacacatataaaaagtaatattagaaagataaatgagagaaagggagtatagactgtcagggagtgtgcagttttctatagggagttaggaaaggtctccctgcagaagtgtcgactgatcagagacttggaaatgagggagcaagccatacagctatctgagggaagagggttcctgacagagtagcaagtgcaaaagccccggcatgggagtgtccttgttgtgctggcaaaataaccaaggaggccagtgtggctgcaagagggaagagggcaattgtggtaggagatgaggtcagagcagtgagaagagacagggaatcatgccatgtagggctttgtaggccatagtacagacttgtgacttttccattgcccttagatccgagtttcatcatctccctctaggatttctccatcactgtttaaccttagtgtaaaaagtctataaaagcttgttagatgaaaacataaaaagggttcaaatgaagaatggacagagaactgttggatttttgccattttttgtatattgatgtaaatcaatatgaatcccatctttttttgaaaatgattcatactatctcttttatagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgtatgtatgactttgccttctaccccccttgcatcagtgcattaaagaaatgtctttctcaaaataatttgtacaccaaacctccgtgacatgcaatttacctatataacaaacctgcacatgtactcctgaacctaaaatgaaagttttatatatataaaaaagaaatcttattacaataaaaaaatgaagaaacatctttgtatgactgagaactattaataattgactgtgtgaaaattccagtgccacatattatgataaatttgacatggaagaattttatacatctctttcttttgccaaaatatgactatgttctcattgtgaggattcatgaaaatcttacctactcagaatagcagatagagtaggctcttgatgttcaagaggagcatgtctcccaaacttgcaaaatcttcaaatgcgtaaattctactagataatatgttttcttctatgaaattggttcgtagcaatgagtaaggatcaccatagccatgctgggatacagatgctgtgcagtctgctaggctcggtcactattctatagcattagattcattttggtctacagagaaaattctaagtgacagctctcatggatcatttgagttgcttagaaatccttgaaactgtaagtgtaaaatcttcagagagacttttttgtgttcatctttattttttcgttctagttttgtctattaaaaataaaacagtgatgagggattctcttacaaaatagcttaaaagtacaacagacttttctgtgtgtaaagggttaatctttatgccatctggcatgaaatttctctttgtgaccatctttcaaatgccatctgtagagaggaatcatgtcttccaaaattgctgatagggcaaagcttttgtcaagtactttggtgttgactgttattagcgcttatgaaatgtatagtcaagtaagttggaacataacagaagagaagatttatttctatactgtaatattggcattattttttaggtagtttcagtaaacgtgtagcgaataaaattttattcatagaacaatttgtgttatttaaatgtagcttttgatttccatttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcccacccctgattttcatgtccattatgagtaggtcatttgaatggagcatatgggctctttatacaaggagttttacttgaaaagcaatgggcgggaactgcttgtgtcatagctgtaatgctacactcttctattctatctggagcaaagaatccctttcagaaagagcttaactgttccttggaattctgacctctgaccagactagaggccataagaagttagccgagtggattgatcatttgctcgctagacttttgcagctaaaaggaaatgagagcacggcatagaattaaaagtagaaagaggcatatgaacaaagctgttcatgttgtaaggagattgatttttttctaaataaaaatactattctttttttcctgattataataagtacattcttatgtagaaaattcaaataatataagaagtataaaaaagaaagtaaaagtctccacccaaaagacaatacctattaacattttggtaaacatcttttcagacatctctgttgtgtatatagaaatatatacacattatgtgtatgcttataaaaattatattcatgctgttttatacctactgtattcttttaatatcatatttatcatcctataccaatatctatagatcagtcatatttatatgaaaggctaacatgacatttcattgatttagctacttaagacatttctaattatttgctatcagaaataatgctgcattgaacctcttgtgcacacatcttagctcatttgttgaattatctccttagaataaattccaagcattaggatttttagggtcaaagattatgctgatttatatagatgatcaaacattggggaagactgctttacatggactgtcactgtctttttggggctgtggatttctggtggcttgtcctcaagttgtcccttatcccctgatagccccttagcttgttactgagactatagttgtcacctctgtgaacattccacaatgatggtggatgcttctgaaagagggatggagcaagtaaagtgttgtaaatatttgagaacttgctattgaattttatgtttaaaatttcctgcacaatatcaaataagtcattttaagccaatgtgtatttcccgtattacttcagtgtgtagcactcagctgtatgttcaatgcaggaagtttaaattatgatttcagatgtcatccagtttgtaatttggaacaggaagaaaatcaacatttaaaaaagatctcctgtgtgccaacattattccatcagtgtctcatgtaatcatactagtttgtgaaatgatataatcactactgtttgacagatggcgaaactgaagctcagggaggttaagtaaactgctcaccattacacagctagtagtggtgacggtaggatttgaatttaggtctgtttgaaataatttgatcaagaatattagacaaatgtaattaagtgccgaaatatataaccctagcacatgccctgccacatcctgggagctttgtaagtgctggtggctggggtagaggacctggcccattttctagcgggaggggccagcaaagtgggtaagagtcgccctggggtggggaggcatattcatgccccttggtgggaaacaaggactgggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaaatttgaaccactttgttccatgcttgctgcttgggaattcaaagctgaatcagccattacgcaggatccttataagctgtttgacttgggggaaatcattagcctcttaacactcaattttctattctgccctgtctacctccaagggttctatctggtacaaatgagataatgtgtctgaaatgcattggaaactggaaatcactatattaacaaagttggtaatatatcaaggaaaaaaacgaaattttggtagagactcagtgatagatttttccacttgaattcactagtgatgcccctttaaacaacaggcataaccaactaacatgctatgtagatgatattatatttggaaggagtcaaactggacaggaggtgttcctgttccacatgcattcaaagaaaaatgtaattttggttgcatctacattagtacatttaagtaaagtgtatggggacaaaatgagttttggattctctgtctcctacctttgcattggaagcaccagagctcttgaactgcaacaaaggaatgtcttttagaggatgatttagtttttctatattagagcagtaaagtttctttttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgttggcatattaaatggcagggatttaaaaaattattgttgagtgtccttaagtggcaatattaaaagttggcaaccctatattgtcatccagatttctagaaaattgtgaaattgtgaaattcaaatgtttggaaatcatcgctctaatctcatcctctccttttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcaccacaacctccgcctcttgggttcaagcgattctcctgcctcagcctcccaagtagctgggattacaggcatgcgccaccacacctggctaatttttgtatttttagtagagacggggtttcaccatgttagtcaggctggtctcggattcctgacctcaggcgatccacccgcctcggcctcccaaagtgctgggattacaggcgtgagctactgtgcccggccaagaatgctttctcttaaactttgctgtgcatcaaagaccctctcattttttttttcatatgtcttgctttagggaagttttctttggctttggttactgctctgactgacaccacttaattttactgcatttaaaagcagaatttatttggtagtcatggaattttttcagaaaagcagaaattatagtgagttatgtacagtataccccctatttcagagttggttgtgtttatgctttgaaaatctatcatagaatatttctggaaaacatactgaaaattcagaggcaactaatgaagtcattaaatgtgagtgtgtaattaatgtattttcttcctgatgacaaattctgccagcatgtgataactatatttcatatctgatggtaggttacattattttatccaaattttgtaaatccatgcagggatgacttaaaacaagtttcttgtttttctccctttttcaagtacaggttcactggcttgtttgtggtacagcctgtacagctcactggggcttctgtggaaaggacaccatgttctgaataattcaatcaattatgttcagtgggtgctagggagtagcataagggtaggagattctaagttaattaactcttttatttgtcactatttataatcatttcattttgggcaaggtctcaaaatgtattgtatgttggtggatgaaagatcactattgtccttgttttgcagactggtaaaaaaaaatgatagctaggggtaggtgaatggcaaagagtagcagaggttggtgtatgtaggcattatagaaggtgaagtatggcttataaatatcagcatatttttaatgctccagcctgaaaagtccattgctgctgctgctattattattgttaatagttattggctgggcacggctgggtgcagtggctcacgcctgtaatcccagcactttgggaggccgaggcgggtggatcacgaggtcaggagatcgagaccatcctggctaacgtggtgaaaccctgtctctactaaaaatacaaaaaaattagctgggcatggtggcgtgcacctgtagtgccagctactctggaggctgaggcaggagaatggcgtgaacctgggaggtggagcttgcagtgagcagagattgcgccacggcactccagcctgggcgacagagcgagactccgtctcctaaaaaaaaaaaaaaaaaaaaaaaaaaaaaaaaaaattggttattggccggccacagtggctcacgcctgtaatcccagcagtttgggaggctgaggcgggtggatcacaagatcaggagttcaagaccagcctggccaacatggtgaaaccccgtctctgctaaaaatataaaaattagccgggcgtgatggcaggcgcctgtaatcccagctactcgggaggctgagacaggagaattgcttgaacgtgggaggcggaggttgcagtgagccgagatcacagcactgtacttcagcctgggcaacagcaagactctgtctcggggaaaaaaaaagttatcaagtgctaactctgttcaaggcacttatctacgtgcttcatgtctattgtcttaaaaggtgggtactgttatccctgtctttgaagatgaggaaattgaggcccagaagtgaagcagaaagacaaaaatataaattattttccaagttcacacagcatgtggcagaacatggatcagaacccagggcacctgccttcaaagccatctctagaccactgtggcatacggtccctctttgggccataccagtagctgcttgatgccgttttaccagtagaaaagttaattttgaagtcttcaaagttagaagctttgatttccagttctaatgaggaattaaggtatttttttcctcctgaattgttttggttctcagcagtagtaaaaacttactcaaaaggctgggctggatgtttaaaagatatatgataaacctctgtttactagaaataaaggaggtatgcttagcgaaggatatgaacagacacttctcaaaagaagacatttatgtggccaacaaagatatgaataaaagctcatcatcactggtcattagagaaatgcaaatcaaaaccgcaacgagataccatctcatgctagttagaatggcggtcattaaaaagtcaggaaacaacagacgctagagaggatgtggagaaataggaacgcttttacactgttggtgggagtgtaaattagtttgaccattgtggaagacaatgtcacgatcctcaaggatctagaaccagaaacaacatttgacccagcagtcccattactgggtatatacccaaaggattataaatcattctactataaagacacatgcacatgtatgtttattgtggcactgttcataatagcaaagacttgggaccaacccaaatgtccaacaatgatgactggataaagaaaatgtggcacatatacaccatggaatactatgcagccataaaaaaggatgagttcatgtcctttgcagggacatggatgaagctaggaaccttcattctcaacaaactaacacaaaaacagaaaaccaaacaccgcatgttctcactcataggtgggagttgaacaatgagaatacatggacatggggaagggaacatcacacaccggagcctttcggtgggttggggggctaggggagggataacattaggagaaatacctaatgtagatgataggttgatgggtacagcaaaccaccatggcacatgtatacctgtgtaacaaacctgcacattctgcacatgtattccagaacttaaagtgtatatatacactttatatatacacacatatatatatatgaagtaggaacaatggagttaattaatgcctattaccacatcttcagaggtatgctggggggaaatatgtttcaggctatagctgcttccagtgtgttgggtgcgtgtatattgttttccattttagcagcagaatagttgcttaaaaatgggagaagaggaggggaagggaataattcaagttcatataggaaactatacatatatagtcatccctcagtatccatggggcattggttccaggatctcccacagataccaagatctgcaaatgctgaagtctctgatataaaattacgtagtatttgcatgtaacctattcacatcctcccatgtactttaagtcatctgtagattacttataatacctaatgcaatgtaaatgctatataaatagttgttatactgtattctttagtgaataatgacaagaaagtctatttgtgttcagtacagacacagttcttttttccaaatattttttatccatggttttttgaatccacggatgcggagcctgtggatacagagaaccgactctacattgtaatctccccatataaatttatccttatgctttttatgaactttatggaaatatacttcacctttgataaaatgtacatattttaaatgtctagcttcatgaattttcatgaatgtatacagtcacgtaaccaccaccccaaccagatatggaacatgtctattaccccagaaagtttcctcatgtcccttgtccattcagccatcttatccctgtcccaggcaaccactgatctgattttcattgcagatgacttttaatctcttttgcaccttcatataaatggaatcatgcagtatgtcctctgatgtttgctttcttgtactcagtgttcttgagattcatccatattgttgtgtgaatatgtagttcattttgagcagtatcccattgcgtgaatatacagcagtttgcttacccattcactttttctgggttattactagtttggagctatagcaaataaattggctgtgaacatttatttatataaatttttgttaaattgctgctgcgcaaattaagaacattcatgtaccatgtggaaatatgcctaggagtggaattgcaggattgtagagtgatgggtgattaacttaatgagaaaccgccaaactgtttccaaagtggtttcaccattttacatcccgaccattgctaattttatcttaatttatcaacatggaatttttttttttaaaaaaatgcttctgttgctgttttagacccattttcaaagatactcaaggctctcttgatctggatgggagattttctcctctgtataaacaagacagtagcaagctttcaagtgaagacattctcaagttgctctcagaatataagaagtaagtgtttggtgtttctgcaataagtaaatataatagatgaatcctcagttttttaaaatgatgaatgtgagtcatatatgggaaaaacagaatgattaaaattgtaagtttggatagagggtaaccagtgcattcagtaatcataattttaactctaaaatattattattttatacccaggccagaaaagaccaaactgcagattattcctgggcagctaaacatcacagtagaatgtgttcctgtggatttatcaagtaagaacatattgcaaataaaccttaagcataatgtttgaatgtcaggttgttatcctttcaatatttttcttgaggtttacgtggcatattagtttcccagggttgccatagcacaaagtactgttacaaattgggtggcttaagacaacaaacatttattctctcacagttccagaggctagaagtccaaaattaaggtgtttgcagggccatgctctctctgaatgctctagggaagagccattccttgcctcttcctgccttccagtagctcccagctaaccttggcatcagttggcttgtggctgcatcactccaacttctcctctgtcatcacatgaccttcttataaggacaccagtcattggatttaaggcccatctaatctagtatgacctcatcttaactaattgcatctacaaatatcccatttctaaataaagtcacattctgaggttccgggtggacatgaattttgagtgggggcgtggatgcttttcaacccagtatgcacgatgaatagttacagattaggaagtgaattgagttgattttatcagatgctgtttcatatatacgaagttgtgagtgtgtcccagtcaggttctattgccttttgcctttggtaacttttacttctgtcatcaactaagagatgaaaaaggagaaggatttcttttcttgtctaaggacaagaatccaagatcccaggagaaaaatagaagacacaaaacacaatttgcaagagataaaatgaagtagctagtaaatatgtgaaaaatattcaatcttagtaataatgccagtaaggcaaattaaacaatatgcttttgctcatccatcaaatctattaaaatgtttaaagtgaagctacctaatgctggctaggttttggccaggtggtatcacctatcatgagtaggagtacagtttggtaatagatatccatagatgttcataagtagggcattccaattctgagagtatatgcattcattcactgaataactatctattgagtaaacgtttattgactaccaacgaggtgctttaaacgtagggagtttaaagtctagaaggagtgacagatagtatgcaagcaaacgagttgtattactccgtttttcacacggctataaagatactacccaagactgggtaatttataaaggagagaggtttaattgactcacagttctgtatggctggggaggcctcaggaaacttaaaatcgtggcagaaggggaagcaggcacgtcttttgtggtggcaggcgagataaatagtgaatgaaagaggaacttccaaacacttataaaaccatcagatctcatgagaactcactcactatcacaagaacagcatgggggaaaccgccccatgatacattcacctcccaccaggtctctccctcaacacctggggattacaattcatggtgagatttgggtggagacacaaagcctaaccatatcacaagggcagctgtaaaaagggtagccagggaacacctgtcttaagctcaggaactgaagagggagaaagagagccagcatgtggtgattgggactgaacattttcagactgagggcatcacatacgttgtaaagaccatcacatatatatgtaaagaccttgaggtgagaccaagctgggtttgcatgaacagaagggaatccagtatagctctagtgtagtatgtgatgggaacagtggagataggagataaaataggaagcatcaggtcatgtaaggaattgtgttgactgtggtaatgccttaaaaaattgaattttattctaaatgcagtgagaagtcaataaagaatagtaaatggaggtgtggcatccactttatattttaaaacatctaagagtacaatggattattttttcctaaagaagcaatttgaaatctaggcagaaatggatccataaagatgttctttgcagtgttatttatattggaggaaaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgccaaagtctcaacagtagttatctctgggtggcggaatgagcaactgtccttgtctaccttcactgtctacctccagatgctctgttataggcatgtatcactgtaataatcagaaaagcaaatccaacaaaaaatacagcatcctcaggtccaactctccctgggtcttccttcatcattactgctctgcagcaaggaccagcagtcttagagccccttaagtatatgaataacctttactacagtgacgatttcaataacatatgctgctaaacttctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaatacctgtcacaccacagtgcctttatatttttactctttataactgtaacccatcaatcagggacctgaaagagaagtcagaacatctagccagcaagaagtgtttatttggctccccatttctcttgcatcagcctaaatcagacagatggatgctgggtcttacactcaaaccacctagggaaacaggctggaatgcccctgactaagtaattgaataatagcccctacctttgaaaagagattttttttttttatgtatacagagaaacttaaattaaggatttgctggctcaaattctgtatgttttctctggttctctgttcagtggagatgagaacaactgctctatttcctccatgcaatatccttttgtagacccaatgactcttaggttacttctcagcagttcttgcaaattgccttcataaccatatttaagaagagttggatattcacttatatggagtttcaatttcatttcttagctggcctggattgctcactctaaagtaacagaatgaggcaattagtacgttggcatgctgactccatattcatccttgagcctattaggcctatagaagtgaaaaaatcccactagaaatgaaattggatctttccttggaaccatagaaagccttacatttattttattggtataacagaaagccactgatattttaaaatgtggctcataaagtgccacatttaaaaatgtgagagaacagcaagcttgtctgtagcttaatacacattcaactttttaattcctttaggccaggaatgtgtctgctggagctttttaaacacgcttcaccttgcccactgcacaaagagcgttcaacaaatgttgccgactggttgagggggagcctctcatattaagaaatgcaagtagcataagagaagtaagctttacaggcctggtttgagacaagtatttcccttccaaatgagtaggcctgttcagctccttactgtcaactagtttgagatcgtgtttctttgatggctggaaattcagaagcatccatacagccaagttacatggtgtctcatttggtgtctggagtgactgtgtaaatgattgggaatttacaggctcacggtgactgccaggtgggcttggccatggccctatagtcacagatgcctctaactatatgtggttccatggcatcacatttacagacctgcatttagagcggtgactctgtttctttcttttgcagtgtatttatggaaaacctgcagggtctgtttttaccacaaatgcttatgctgttgtctcgcatcacaaccaaaatccagagttctatgatgaggtaaaaatatattatcctgacatttctaaaacacagtggttggaattctttttctctttgaatcattttcatcattttaccagcactttcaatccctgagtgttttgttccatgaaaacagaaaatattacaacaaaacagagtgttactggcctgcttggtgccttttgatggtagtagaagatttaccccccaatttaaggggctcttcgacttgaggtaacaatgcaggaaacaaacatgagagtagagctagggttctagccctcctagctttgacagtgctggctctgtaacatcaagtcacttccccctccagagtctccatttcctcagctttaaaatgagaaattcagaagagattttcagaatgcctttctagctctttccccttatggttttacacagtagggtgcagcctctctgtaactgaaatactaggaaagacagggatacagctgggccaccagaatcccactggctggcctgcatgcttgggtgcaaagcacataaaggggtatggttgggtctctgagcctctgtggttcctcctgactcagcctctcaaattgtgtctctgcctttgaaaccctgtctctgcccctctttccttcttcctacttctccacctctacatctctgtgtgcttcccagcatgtctcttagcatctctgtcacagccacttctggtctgtatgtatccagcatatccaaatctgtagtctccttttgattcctatatgtctctatggaacctggatgggcatcccagcccagacgttctgctgtccctgcttctcagtccacatgtctccattcttggcttggtctgaaaccatccccccggctgtggtgattttgccatgtccacctgctgttgtatggaagccttatatcccagccttaggccttgctcatttccttctcaatccaatgtccctagtttcatgggggatggggaggggaatagtatttttgccacccagggagggagtatgcccatatttatgtgcagcagagcattacatacccagatggtctggatgctgtgaataggcatgttctgtagtgaaatagacctaaaacggacattagttataacatcaaaaccatgctttgtatgaatgataattggaccagatgtccatcaccaagttgtttaatatgtgtatctctgtaaccaacatcagtcactacaaaaaacttgatcatgtagtaagtaacccacattatttttaggatacctaaaatgaacatgcttttctttttttttttatagctctgattttttaatattccccttttttcctccctaatcattcttttcttttttattattattattacactttaagttttaggatacatgtgcacaacatgcaggtttgttacatatgtatacatgtgccatgttggtgtgctgcacccattaactcgtcatttagcattaggtatatctcctaatgctgtccctcccccctccccccaccccacaacagtccccagagtgtgatgttccccttcctgtgtccatgtgttctcattgttcaattgccacctatgagtgagaacatgcggtgtttggttttttgtccttgcaatagtttgctgagaatgatggtttccagcttcatccatgtccctgcaaaggacatgagctcatcattttttatggatgcatagtattccatggtgtatatgtgccacattttcttaatccagtctatcattgttggacatttgggttggttccaagtctttgctattgtgaatagtgccgcaataaacatacatgtgcatgtgtctttatagcagcatgttttatagtcctttgggtatatacccagtaatgggatggctgggtcaaatggcatttctagctctagatccctgaggaatcacctcaccgacttccacaatggttgaactagtttacagtcccaccaacagtgtaaaagtgttcctatttctccacatcctctccagcacctgttgtttcctgactttttaatgattgccactctaactggtgtgagttggtatctcattgtggttttgatttgcatttctctgatggccagtgatgatgagcattttttcatgtgttttttggctgcataaatgtcttcttttgagaagtgtcaatgaacatgctttcaatcattcactgtatattgactgagagagacagagagaatatttgcacgtgtacctttgtgggtacatgcatgtgcatcaaatcatttaaatctgtaatttgtctcttacatacttccaggaggcattacaaacattcggttgggatctgattagaaaattacttgtgatactttattacaaccattaatttttaactaagtttgtatgtcatggctgataattttcatctttaagagcaaagttgtgtttttcttctagagaaatttctataaactataatttgtggatactataagaccatcgttactttttgcatatttatttgtaatggcttaattttttcatgcaaaagagagcaacaacttagaaaaaaagttgtttttcagattcagtgtacattttaaatgggttgcattcattgatgcagattgagttgcatagtatccctgggctgtgatgatgtagttttgacttagtgttttagaaaattctgctgcaaaattgaatccaggagaatccattgtactctccagcaaaagtaataaatcaactctcacaactcagaatattgctgtcaaattgaaactgaccagaaaagcatttggaatatatttaaatgatacctactatttggccacttggccagtcctttaggaagtatttttggagcagtatgatgaaactgaactaatgtctgacagtttcagcttgagaaaacgaagttccatgtgtaattttgctttcatttcagattaaaattgagcttcccattcacctacatcaaaaacatcatttgcttttcactttttatcatgtaagttgtgaaattaacacaaagggaacaaccaaaaagcaagacacagttgaaactccaggtacgtgttctctttaaatgtctctctctacagttatttgaaatggaactgtccagggtataacctcttttcaccaagctatagaccacttctccccttgaccaaaaaccactgtattagttcattttcatgctgctgataaagacgtaccagagactgggaagaaaaagaagtttaattgaaccttacacttccacatggctgaggaggcctcagaatcatagcaagaggtgaaaggcacttcttggcagcagcaagagaaaaatgaggaagaagcaaaagcagaaacccctgataaacccaccagatctcgtgagacttattcattatcacaagaatagcacaggaaagagcggcccccatgattcaattacctccccctgggtccctcctacaacacctgggaattctgggagatacaattcacattgagatttgggttgggacacagccaaaccatatcaagcacatttctgattttaaaagttcattggtaaaatgcatattatatgttcattttagtatttctaccaaatatcattgtccatatgcttgccaatgtgcttagactactataagcaacataaagtaatattgctattctcaaaaagaaacacatattgcgatacagtatttttgttatttcttttatgtagaattgcccagcaaccagaattttccagttctgctcactgaggaagagggaagtgagcccagagccagggacatctgtgagccagagggaggttgggggctgactagttctaatgagaagataactgatttaacaaacttgaataagcttcagcagtgaagctctcgtcatgggcccattcagcaaggctttacgtaaaccaatgggtagcacccttagcagaaatagaaggccttgtgaacacagcttgtatcacaagcactttacgaacatcagcatgtcctaagattcagatcccagctagtctgtattattcactcattcattcattcagcaaatatttctgcatacaggttgagcatcccaaatccccaagtccaaaatgctccaaaattggaaactttttgagcactgacaagatcttcaagggaaatgcttattggaacatttcatattttggatttttggatttgagatatcaactggtattatgcaaatattctgaaaaaatctgaaaaaatcagaaatttgaaacacttctgttcctaaaaatttcagataagggatactcaaactgtattatgtacaagatattgtagtaggcactttggagaatacagtggagaatcaaacacagatctcatcttcagtgaggatatgatctagtaagggaaatgagtcctgcgtaaacaattataatacaagatagaaagtggtgtttaagaaagtagtgctacgtgaactcagaagagcgagttattcagctggtggagagacgagtggctgagaatcagagaaggcttctaggagatggtgtttgagtgaggccttaaagggttgggtggggtttgataatgcaacaatggcaggaatgtaggggattatggggtgaaggaacagcttgtacagaggcagagtatcaagaggcatggacaggaaaccacaagtagttcactaagcctggagcacagggtgctaggagggggatcataggatgtcaggttgaacaggaggcatcagattttggaaagccttgaataccaggctatagattttattttattctatcaccacagtagaactattggagggttttaaacattagagcagtttttcaggaaaaccaaccaggcagcagtataatgggcaaggcaagtagaagcaggaagaggaagaaaggaacaccagttagagggttatttcaaaagtccaggaaaggaagaggccacactatggcagtagcagcgggggcagagagaaagggaagtgcagaagaagaacatattggacctggaaagtgattggctattagagagatgatttagttagcaatgaagtttcaaaactgggtgattggaaagaaggtattgccaatagcaaaactgtgggtagggatggcaggtttgggacatcagttgagttttaggtgctagtgagacattggagtgatacccagcaggcagcaggactgaatatgagggagttccctttgcaggtagtatggatatgttctttatccccatagaaattgccgttagttcagggtaggggctttgaggattgagaagaaaactggcagaacgatgagaacccatgaccatgtgtacatcctgaaagctaaattactgattcattatccaaatcctagacagaagtggacaagatgctcagcggagcatgaaacagttattccgtgtgccactcatcactttgaactgtgcattctttaagtggcttcccacctttgagccagatggtgtgcttgacattgtacctttatagcttccaagtgctctctatgagttttgaataggggaaacgcttggtcgtgctctgattcatttacagtacaaaaatgttgcctaagcaatcccacagagacagaaagtagactatcggttgccaggggctgggaggagagggaaatggggagtgacttctaagggctatgggatttattttgggggtgatgaaaagttctggaattaagtggtggtcatggagatacaactttgcaaatatactaaagaccactatatgtacactttaaatagatgaattgtgtggtatatctgaatgaggtctcaataaaaatttctatttaaaaatgttgcttaagaacaagaaatagattttcctttcattttcctattttctgggctggaaatcttttctcatttgtcaaatttttagtttaactactttgacagagtcatttctaatggttcttctgctcatgttactttcctctgctttttataaaagaaaaggtctgggtaaagcatttctgtagttgaactagtaaagatgcccgtcaggcacatttcggagtctgagaaagccatttagtctacttagagaagcaatgttttagtctccttttaagaattaaagcatttgccaaattaaacacataaatgaaaacattctaaccagatttgtgttgacttctgtgttcacagtatcacacacacactcacacacagagtcacaaataattttaaagaatcagaaagcagtagctttaaaaaatgttctccagccaataccctctctcatatgccaaaactcagtccagagcaagcttttttacagctgagttataaacacttgaatcccagagtaatttctataatggaaatactgacaccactcaacttgagtaacacagatggctctggcttttttagctagaacatgatgagttttctaattgaaagccaaaaggctcttttggggagaactgttaagaaatgtagagattggggaaaatctcttgatggattcaagtcataaacactatttcctgcctgcattctcctacctacacctacacctcttccttctgtaatcaggacaagtctgcctaactaaatgatttatgcctactgccttgtataaatatggagtgtagccgtgactttgtgaccttaattttccatagttccttaccctagggttgccataagaaattttggaacatgtgattgttatctgaaatagtctcagccgtgagactctgcactcttagtgtaagaatggatgagaactatctgagccttttgaaaataaatccaccaaaaatatttcccaaagcataaagataatggtatcgatgcgcttttaaaggtttaaaatgttttcatataatctcactctaggtttctcaataattcttgtagatggaaaggccatgttgctgttcccatttttatggtcaaagaaatagagtacataacttgttagtggccaggctgggattcagagtcgatccaaacccattgttccttccccagtactcagttgcccagcacctgaactcccacatacagatccctggagacatcaccaccctgccctgccccctagcagtcagccatttgtgtagctgattgcatttgatatttcatttctcacagtttgttattatcttggcagttgggtttgcctgggtacctttgctgaaagatggtagaatcatcacatttgagcagcagctgccagtttccgccaatcttcccccaggctacttgaatctgaatgatgcagaatcaagaagggtaggaaaatactgcatttgttgaagtaatcatgattaaatgtgcaaaaaatagaattctgttggtctcgattgtttagtacaatgttactcaaagtggggtctgagggctggtgcgggtccacaacaaagataaacatggaatgtgcatgtttagaatttatagcagtttgacaaagtaattttatgtctgttgattttaataatttttttagtggggctcagattttgtgcataattttaaaaaattatttaagtaattcattttatcataatttataaaaatagtctgcaaaggattggaaatgtaaaatgatttatgatacatttattctaaaggcagggtattttctccagtaatctcttggtatgaaattaatacattcatttctgaaaaaaatgtttaaatgcataaaggtattatatgttattcatctatccattattatgttatagaatctcaattttctgttcacagcaatgtaacgtggatattaaatgggtagatggtgcaaagcctttgttgaagattaaaagccacttagaatctaccatttacactcaagtaagttgcatcatttgaattttgtcaatttttatacttgagtttgtttgattaaaatagaccacatttgattcctacagccttagagaatatgtgacctgcaagattttctcattagtaataacatctgtccaggtgcagtggctcatgcctgtaatctcagtactttgggaggctaaggcaggaggattgcttgagctcaggagttcaaagctgcagtgaactatgattgcgccactgcactcttgcctggaagacagagtaagaccctgtctcttaaaaaaaaaaaaaaacagtcattctatctcaaatattataattcctctcaaattacatgatcttttaattctcattaactgatttgagcctcacagaactctgaaaggaatgtggaagccatcatctccattttataggtgaggaaactgaggctcaggcaggttaggtgacttacccaaggtcacagagtagtaatcaggggaatcaggtcaaaacacacatttcattattctggttcctgatgtagtccatgctgtctacagaatcagtgtatatgggttccacataggacagttggactcccttgccagtgaagtgccatggtaaatttgggtactgaatgcctgagactattgttctgctaacttcctgctgctatcttttctttatcagttcacatctttattatttatttatctgtatctttttcagttcatacctttattcctgcttatttcattaaaatggagaagcagcccaacttcatagaacacactagtcaaagtcggaatcaaatgaatctttagctagttgggcataaatggtggcctaccccatgtgcttgtgtacatggcagatttacctggttttgctgctttgtatagtggtcaagagctgctgagcctgggcattagaataccggataaataggtctgcaagatacaggaggagggagaggtagagagcttgcatttgaggataatgaatcaaatttcatatggctgtttccatctgtgttccaggatctgcatgtgcacaaattcttccatcattgccagctgattcagtcaggctcgaaagaagttccaggggagctcattaaatatttaaaggtaaatgaacagcagctttctgcaaaacgtttgtttttcatgtctttctgttgccacattttggtgtgaaaaaaaaaagcaaacagacagtttaaaatatttttggctgtatttcctcaagagaatactttctatgatgtatttttccatcatgtggctgtttagaagcagacagcagagtggcaacattaggaagaaaatgtaatagccacaatgcagcatcatatttttgaaactctcatgaaaatgtttatttcaggtccataaattgatttttcaggggctttctcttcctgctgactgcccaataaaggtggaggatgctgtgggggaaagggccaggaggaatggaatcactttgacttggaatgaaatgtgaaattgttcttgtgtccatgggtgatagactaacaaaggggctagctaatgaaagacacatattttatgcatgttggcatattgtatcttaccacatgtatagaggacctaacacttggttttttccctgtgtgctaggactacagtgcatatcataatttgcctgacagtggctctcttcttttaattgttcctttagtaagatagctatagcaagtctgaggaaatattattttaaatgaaacatctttaggatttacctttggacatatgctattacttaatgatatactcaggaaacaaaaatgttcatttctttcagagaggtagtatgagatgagatcaaatatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaagaaaaaagaaaaagattagggcatctgccggatagtaatcgttcatgccacacttatttctttagtgcttcctatgggccaggcatcattctaagcattggaaatttaagtggagaaaacaaataatatccctattgtcaaagagcttacttgttgagacagacaataaacacataagttaataaatatatacgtcatctcatatggtaataactgttataaagaaaaccagcacaatgaaggggagcagggatttacaaggggtccctgttttaaagtggccagagaaaatctctctagtaaaggcacatttgagcagagacctaaaggaaatgagagtgccagccatgtggatttctcggggagagctgggaacagcaagtacaaaggccccgaggagcttggcttggtgtgtttggggaacagcaagaatcccagtgtggctgggacacagagtgataggacattaccttggggaggttgctgggagcttgtcgagtaaggcttcataagccatggcgaggagtttgaatttactccgagtgagataggaatatggagctttggacagaagtgtgacatgatgtgactttggtttttaaagtgtcattctgcttaccatatagaaaacacactgttggaagagtagaagggagacagtcaataagtggtggctatatggctatatgttcttaactatcattaagacgtataataggccaggtgcaatggctcatgcctgtaatcccagcaccttgggaggcccaggcaggcagattgcttgagcccaggagttcgagaccagcctgatcaacatggtgaaacccatctctataaaaaaatacaaaaattagccgggcatagtggcacacacctgtaatctcagctacttaggaggctgaggtgggaggatcgtttgagcctgggaggttgagtctccagtaaactgtgatcatgccactgtactccagcctgggccacagcgagaccctgtctcaaaaaaaaaaaaaaaagaaaaaagtatgataatcatctaacttttaaatcctttcctcaggtaaatatctaggacttcaatatgtatgaatgctttgttaaggtttgttcttcacatgggaaagttttataaaagtttcaatcaagtggaatggaaaagaacatcattttcatatatacgggtattcttaaaatagaaaagttctcgtatttgtttttctgaagatgtggaatttctggtatttatgtgacctacgctctccctctagtggtagtcaatgaaataccatgtgatttcagaaatagccaagctcctctatataaccttagtgctgaaaaggattcttaagactttttttctttctttctttttttgagacagggtctcactctgtcgcccaggctggagtgcagtggcgtaatctcagctcactgcaacctccgcctcctgggttaaagtaattctcctgcctcagcctcccgagtagctgggactacaggcgcccgccaccatgcccagctaattttttttttttttttgtattttttagtagagatggggttttgccatgttggccaggctggtcttgaactcctcacctcaggtgatccgcccacctgggcctcctaaagtgctggcattacaggtgtgagccaccatgcccggccaagacttttttttttttttttttttttaacagatgaggaagctggggcccaagtagaggtgacttgcctgtagacattcaactggttagtagcagaactggggtgagactatgacaagtcccatgttctttctaccacaccttgctatctcttgttcctataaatgacattgtttcaagaattcatttaccatccacttgttgagctcttgttatatatttagtattttcctagctctttgaggcttacagagaagaataatttagggttattgtccataggggaacttacagtctaactgaagagacaggacatacataagttaaatgacagtctgtcaataatacaattaatagttcaaagcaatatatgattaaatgtccagtatgtgatacagggcacaagtgctgagggttcggtgaactgaggaactactgtagactagagggctcctgtctttttttttttggagacagagtctcactctgttgcccaggctggagtgcaatggtatgaactcagctcactgcaacctctgcctcccgggttcaagctattctcctgcctcagcctcccaagtagctgggattacaggcatgcaccaatatgcctggctaatttttgtatttttagtagagacagggtttcaccatgttggccaggctggtctcgaactcctgagttcaagtaatccgcctacctcagcctcccaaagtgctgggattacaggtgtgagctgccgcgcccggcctactttcttattttattcatttattcagtaagtcaccaaatatttattgaccatgtagtatgggccagacattgttctggatgctatgaatcaaatggggaacagtttagacagcataccttttctagttgtggtagagagattataagtgagtgccatgaagaaaagagcaggttaatgagatccaacatgaccaggagtgtattctacatagagttgtcagggaaggcctattgggggaaatagcatttcaagctgaaaggatgagaggaagacaaccttagggggtaaagtcgtgtaaaaggataacagaatatcacagtaggtgtaaacaccttacatcagcatgtttgaaggacagaaaaataaaagaccgtgtagctatagtacagtgtgcattgtgaggggaggatggcaagtgacaggtttggcgggacaggccgggtatgtcgtaggcatggaagcttatgatagctctttgttcgtggtagtttgttttgttttgttttgttttttaacaacagaaagatggcaatgtctaatttgcatttcagaaagaacactctggctgtcatgttgagaataaattacagaggactgctactggtagcagggaatgcccatctctcttttctacctggcactattctatttatcatttaccctttctcatctctgaggccttaccagacattccctacccacttgcacactcagttgcttctttgtgcattttgtatattccatgatcatgctatttactgttgatattgcaattatttagttccatgtgtttatcccctgtacactgtgaactacttgatggtagaaaccatggcctttatttgtttgggtttacttttgtttttggtgtgcttggctattggaagttcatttgtttgccctttgtcgaatgagaaaatgaatggtttcactgaagtggggatttgtacttgccttgaaagagtagccaggatttggctaaaaacgatgaacagacacaaaggcaggaaagtatatgatatattcaagaacagtgaagaaaccagagataccagtttggccttgtagagaacagtgatgattgtttaggctgaaaatgtcagttaggtctgaaataacttggtcttgatactctacgccaggatttctcaatcttcgcactattgacattttgaggtagagttattctttgtccgtgagggtctgtgtgtgcgtcgtaggatatttagcagcattgctggcctctgaccactagatgtcagtatcactccctggttgtgaccaccaaaactgtttccagacattgccaaatctgtcgggaacaaaatggcccctggttgagaaccactgccataggctatggggagacatcgaaaaaatcttggcaggaggtggtctaatgtaacgagtatttgaggaagattaatttagaaatgagagttggatgtatggagagtaaagagaaattgtacagagacctgctaaaaagaaaatgatttatactattttggttattgattagagggtcttgaagacagatagtggcaaaagtcagggaatctgggaaagagaatttatgagttttttaagtacagagacttgatttatccacctctctatttcccctagcactacacattgaattgatatagaaagatgctcagcgaggtttgtttccttttttttttttttttttttttttttttggttagctggttgagtgagtgaatgatgtggagagaagggaagaaagaagaaagaaattgaacaactttcactgtttgtattatttctctgtatatatgatcacgtttcttctttttgatgtttgtaacgcacttatcattggagacacagtgttagcactttgaaggaaatgtattgtgagattcttagactgcaaaagtgcttccgttttgtagtggtgatggtgtagagccaattacatatagaaccactctttattgcattccacttaacttgtcaccagattaactgatgcccacattcccctgcagaacatacagaatgcctgggggttagtagatgcatctccagtatcatctccaaacatctgttcctccccactgccccaggcaattgagtgttggtttaccaggagtcagttgtcaattttctaaaaactgtttatccaaattatacttattagctttagtaaagtgtttaatgttaaataacaaaatctgagtgccaaatagaggtgtggattaagtaattaacaaaaaagccccctatccaatggaaagctcacttttaattgagcttatatgctagtcaatgtatttctcactacttaatttttttgctgtttcacatttgcaaattttatcatatttctgtttgttttcataactaataatgacttaattttagtgtttgcatgccatggagatccaagtcatgatacagtttctacctgtaattcttatgcaactcttccgagttctcacaaatatgacccatgaagatgacgttcctatcaactgcaccatgtgagttttggtgttataatacaaagatgctatttatttgagatctttcttattttttaatggaggtattcattactataaacttccctcttagaactgctgttgcattccataggttttggtatgttgtgttttcattgtcatttgtctcaagatattttaaattttcccttttcttttttgactcaggaacatgtttaatttccacctattttgaattttccacggtttctcctgtgattgatttctagtttcattccattgtggttggaaacaacacttgatatgatttcagtcttcttataattcttagggcttgttgtgtggcctaacatatatggtctattctggagactattctatgtgctcatgaaaagaatggatattctgttgctgttggatggaatgttctgtatatgtctgttaggtctatttggtctaagtgtagttcaagtccaatgtttccttattacttttctgtctggttgatctgtccattgttgaaagtggggtattgaagtcctctatttttctattgcaatatatttctcctttcatgttcgttaatatttgctttatgtatttaagaagataaatatataagttccaattgaactttttccaattatgtaaatgttctgcacttgtgttgttcaatatagcagccaccagccacatgtggctattgagacttcaactggggctggttcagctgaggaacagaatttttttttttttttttttttttgagacagagtttcgctcttgttgcccctgctggagtgcaatgtctcacttcgcctcccgggttcaagcgattcttctgcctcagcttcccgagtagctgggattacaggcgcccaccaccatgcccggttaattttgtatttttagtagagatggggtttcaccatgttggtcgggctggtctcaaactcctgatctcaggcgatccatccgcctcggcctcccagtgctgggattacaggcgtgagccaccgcttcctgcaggaactgaatttttaattgtgtgtaattttaattttaatcaatttaaatagacacaggtgactagggatgcatatttaacagaatgtggccccaagccatcaatttttacttgaaagaataaggaagtattatttttatgtgaaaacaaacaaggatatattgtagagtagaatgcaaaatgcacctgaattttgaaatcaaaacagggtacttaaattgtgggctgagtgctggaagtttctggctttggctttgctgcctctgctgttgccacaacctcttccagcaggcctcacaccacagccacacaccatttgcgggcatcgctgctgttggggatagtgttgttgaaaatggaagaaactttaggccagtggtttccaaaacatggttcccataccagtagcatcaatatcgcctgggaacttagtaaaattgttaatcattgagcttcactccagacctacaaaatcagaaattccgggagaggggctgagcaatctattaaaagggcccaccaggtgcttctgatatatgctaaactttgaggacactgctagtctcttacccccaattatagttcatatcattacacctgccccggctctcccttccttttccccgttgacatgcttttcattgcgtctttattcctttcctttccttctcctttcctttccctttcctttccttttccttttcctttcctttccttttccctttcccttttcttttcctttccttcttttttttttttttttttttttaggtggagtctagctctgttgcccaggctggagtgcagtggtgcaatcttggctcactgcaacctctgcctcctggggttcaagcaattctcctgcctcagcctcccgagtagctgggattacaggcgcccaccaccacacccagctaatttttgtatttttagtagagacagggtttcactgtgttggaaaggctggtctcgaactcctgacctcatgatccacctgccttggccacccaaagtgctgggattacaagcatgagccaccgtgccgggccttcatttttttttttttttttttttgagacagagtctcgctctgttgcccaggctggagtgcagtggcgtgatcttggctcactgcaagctccgcctcctgggttcacgccattctcctgcctcagcctcccgagtagctgggactacaggcccccgccaccgcgcctggctaattttttgtattttttggtagagacggggtttcactgtggtctcaatcttgtgccctcgtgatccacccgccttggcctcccaaagtgctgggattcagccttcattttatctttctattctcttccttttattctcactagaggagatctcaatatttacctaatttgaagtcttttactggatagtagctaccaccatgcttcagacacatacagagatttagaaacagatgtgacatctgggttgtcaaattaaatatccttcttttgaactaggaaatatatttcataaggcccaagcatgttagatgctgaaatctttgttatgcctaaactatcaccattatatctaatgcaatcatctcacttttaattattcaggcagtgttagatgttttgggggctagacatgacgatcttaagaatcaaaatatgttaattcattatagcatgacatgctgactcttgtgaatgtcgtttcagggttctcttacatattgtatcaaagtgccatgaagaaggcttggatagttatctaagatcattcataaaggtttgtggagtaaagtttctttctgagcaatttgttttatgtgacaattttgtcttacagttcatttttttttgtttgtttatttgtagtatagcttccgacctgaaaaaccgagtgctcctcaggcccagctgatacatgaaaccctggctactacgatgatagcaatattgaaacagtctgcagattttttatcaataaacaaattgctaaaggtatgaacacaggacacaacaaggaacaaaagcagccatagacacactttttttgataccctcccgtttcacttctagtctttcatcagtttcacatgtgacccgtcctttctccaccattttgcccatgcatccttttcctgaagttctccacagaaccttcttcaccccaactacccaccccctgccctcatttaaatgtgtaaaagaaagaattttggatcagatagacctgagttagaatcctgtatccatcacaaaatagttttgtgacctggggccaggtatttaacatttctgagcctccaagtcctcatttctaaaatacaagtaaagcatttaacacatcgttcctggcacattgtaggcactcaagaaatgatagctcttattattgtcattatttttattacttcttttattaatggtagaatttcgagtatcttggagtatatctgattggggcttctctctactcttcaaattacatgaggtaggcaaacatctaggctacttaggctgcacgaatgtcacatcaagagcagggttggggtccaagctaagtgcaggtggtaataagattcattgtctatagagcatttaaaagcggtaacaagataaactagaagttagtttgctcttattaccacttgagggcaattagaaacaattttggggataaaatactccccagtgggacaaaggttcccatccttcctttatatattaccagtcaaccctgaagtacaatagtacctttttgctaaaaccatttgcagatattctgtgactttgatagtgacttgggatcacttgaaaatgttagtaaaattcaaagacaagacccatattgatctgtcaaactttgctaagcttcagagatttggtaaccgttaaagattctctttctttttttttcagtactcatggtttttctttgaaataattgcaaagtcaatggccacatacttgttggaagagaataagattaaggtaagtaaattaaggtaaagaataactttcaattggcaaatgataattgtatatataagaataatatttgatggagacaaaaaaagctaatcttactctcagatagccatgccatgcaaatcccattttatatttaaaggctgctagtgcttggctttttcaatgttgcttacaaaacaatggatctattgcataaatctgaggtctcgcagttgatatgttctcaccgtctaatctgcagagacttttccacatagattctttcctataatcatttgccatgtacatctcattacctttgaagctttgcctttgtcttatggcttaaaaatgtctctcgagaagacccatttggttaaatcagacatagcgcttgcccatgcacgtggagtgttacaaacactttatgcactagatatgatcccggaatgtgatgtatacattttgttgtaatttttaattgtttgaaaggtataaaaatattttcttattcataggaatcataaagctaagacttgtgaagtacaaaatatttaccttatacttaattattttttatcagaattttcacagaatatgtttactgaaattgaagtgcatgcatactttgtgtgccaggaaaaaagtagaatgaaaactgcgttgtgtctgtaactcagaagcatgatattccaaagttggggcagaacaacccattcttgctgataacctcagtcaggtagattattagagatccagatagttcctgtaattatatagagtgaagtacatcttgaactagtgatgtcatttttaagttgggagaacaattatacatcagttttaagatatatttatttgtagaatgtgtttgaaagtaaaaatggcaattgatttagaccttttggaagtctgacttttttctgtgcctatttcatttcagcttccccgaggccagagatttcccgagacatatcatcatgtcttacattcactgcttcttgcaataattccccatgtgactattcggtatgcggagattcccgatgagtccagaaatgtgaactatagtttggctagcttcctgaaggtgagttcaaggcagctagaatgtggtaaggaactcctcttcattgataggaagcccaagaaaaaaattaagcactttctagaggctcagctaggtcttcataagactgttggaaaacttaggttgcttacaaacgttggctattgtgaacagtgctgcaacaaacatgggagtgtagatatctctttgatgcactgattttcttccttttgggtatacatctaagagtagaatgttggatcgtatggtagctctattttcagttatttgagaaacctccatagaagacattggcattggcttgtgttctatatggcgattcaaaaatgtgagaggctggccaggcacagtagctcacacctgtaatcccagcactttgggaggccgaggtgggcggatcacatgaggtcaggagttcgagaccaacctggccaacatggtgaaaccccgtctctaccaaaaatacaaaaatcagctgggtgtggtggcaggcacctgtaatcccagctacttgggaggctgaggcaggagaatcccttgaacctgggaggtggaggtttcagtgagccgaaatcacaccactgcactccagcctgggcaatagagtaagactccatctcaaaacaaaacaagaaaagatgtgagaagctaccttagtagtcaaatttaactatatatacaagataaaggtgataacaataataccagaaatacaaacaaatctgttcttgatagtgattgtactaatttacattctcaccaatagggaaggaaggttcccttttctccacatcctcaccaacacttgttattgcctcttttggataaaagctgtatattttagcttacctgatcacaacaaatttgtccccatcccccaatgaaatgacaaataattaaatcagaggacacatacaggtggcctagtcagaagacaagtgttgcttgttgtacacagtgtttttaagcatagtttgaatgcttatttaaatgggagcacatactttctaggttgccaccatccctaccactccttattacagccctgagcctcctcattcatttaaatcgtttctctgaccccgttggcttttgactttgcaacttttggactaaagcaacctgtttggtgatgtaaccacagtgtacatgttgctaatacgtgtaaatgtaaattgttagtgttgatcagtgaggttattttatttgggatataccagaagaaaactatatttatgaaagatggcaaactaccatcattaggttttgttattgtcagtatgtaagtggcagtgagagaatgtaactgttttttctttcttttttcttgctttctttcatttttttttaatttgagacagagtctcgctctgtcacccaggctggagtgcactggtgcgatctcagctcactgcaacctccgcctcttgggttcaactgattctcatgtctcagcctcccaagtagctgggattacaggcatgcatcaccatgcccagtatttttagtagagacaggggtttgccatgttggcctggctggtcttgaactcctgacttcaagtgatctgcccctcttggcctgaatgtaactgtgataaagtgggtaacaacaatatttgatgtgtggcagagacaagcgtgggttgcaaatgcacctagtttttacttgcctctttccattctccctctcttcatttctcaaagctcttcattactctcaaaactcttcatattaagaaccttgtgggcagcaattcatccaaggagttttagtttctaacatatcctcattgttaattaaaaattcacaactaggtttcacacatcttgagtatgattttctgacataagacttctctttgccagaattaaaataaagttttaaccctattacactagccttttttgtgtattaaaaaagccaacatccacatatctttttaaaataaactacgaattagattatctgaaatgtagaatattagcttcttccatggagtttaaagttgaagtttactatgtaaagggaatagaacatttttggtttagtagcagtatttacttaattcaagtcagcaaacattggcttgacttctgtgtggcaattcaaagatgtgagaggccgtgttagtagtcaaatttgaatatatatacaagataaaggtgataacagtaataccagaaatacagacaaaatactatagaaaaactagaaagggagagagagattatgaccaggcagcatgaaacaagtaacatagtgcagagttccccaagacaagagttgagcatgttgcagttagagggtccctgaacaaagatgaaatatgcatgttcaaaaattgttcagggacgagtgaaaagtcgtgtgatgagtttaggatgtatggagaaagagctggaaaggccatctggtgccaataatgaaaggccttgaatgtcaggttaaggaatttggactttgattcatatgcaatggagtaacaccaaatacttgggaggatacttttcttgctggtatgatagatgaagtgaggaagagactcgagtcagggcaaccgattagaaaaccaatcatccgcgtggcacaatccacttatcttttaggctcagctcttccctggcctttccatgcagtgttgatcaccccttctgttgttcacctgtcttttacatagctctgtggcactgttattgtgcactatcttttcattatttgtttgtcttcactattagacatgattatggaccatgccttattccactttgtatttctctagaatgtagtacattgtctcaaacatagtagatcctctaaatgtttgttggatgctggaataaataaatatgagcctcactcagtaatccagatgagaggtgatgagggtcttaccctgggcagtggcagcagaagtataaaggagagtatgagatgcaagatgcaggtagctggttaatcaaatattgaattcttcggatttcacagaaatattctaggcactatgaaggatataaaggaaaagatcattcttattgtccaatctaggtgagacgacaggaaaacagtcagtaaaatacaagctaatactgaaataaagtgtttaaaaggatccatggaccaatgtagttaaggaagatgggatttcatgagaaccttaaagaatgaataagaccagatagaagtagcgaaagaattgctaggtgtggcataagccaaagacttagaggtgggaatacacagtgcatctcgaggggataataagtgaatgatggctgagcatgctggtgcccgccttagtctcagctacttgggagacaggcaggaggattgtttaaggctgtagtgcgctatgactgtgctaccacactccagcctgagtgacagagcaagactctgcctgtctctctctctctctctttttttctgttttgagacagagtcaaagaaagtcaatgagatctattggcaaatgaagctggacaagtaagttgggaaaagactatgagtgttcttgaatggcaagctaaggaatttgaaattgtattagagacaatagggaactattggaagctttggggcaggaaaatgacaccattgggctaggacttagaggttaatctggaagcagatggatagagacatgagagacatgaagactgaggaggttaactgcagtttttcagttgcaaggtagtgagagccttaactaggacaatgacagtgggcaaatataaataacttggggctgtcacagagaagggaggttttatgctttgacttcactgaacacaaaaactcttttggtctgaattattaatatttacataggcaagcctcactttcatcagctaacagactaccttacacttccctttggaagtgggagttgaccaaaatgaggtcaactcgcttgggctttgagagttgaccaaaatgaggaagtgtagctgaatagattacagatatgtatgtgtgtctgtgtatgtatgtgtgtgtatgtatagataaatgtatatttgtgtgtgtggctatatatacatcttgttctgaaaactgtataattgaggcccttcagtcccaattccagtgatgccacttgccctttatctttttctttaaggtcacctgaagctcagaaagttatctataaaaataaaaatgtctttctttttgtgtggaaccaattttgaatttttaaaactttacatttttaaaatttagacttttagaattatgtaattaacccttagttttgttttggtttctatagcgctgtttgacactaatggatagaggatttattttcaatttaataaatgactatatatctggattcagccccaaagatcctaaggtaagttataaggacatgattgtagtggatgtcagacatctgagcataagaccaaagtgacatttattctcttctaggggattaggaactgttgtttttatttaggtagttggactatagacatacgtaaaagcaaggaatactggactgtgttttggggtccccaggaccccccatgtgttcaatagctcattttaaggattcacagactcaacatatagttgtattgatggctgagattcatgagcgtgacataatgaggatactcagctgaatcgggaaaggaaaagacatcaaatggggtgggtagcaatccacatgcagcctttttgagctctttccctcctgtgaagggtctcacagagcacagcctccttctagcagtgaaaatgcacttgtaagtgtgcaatatttctgttcaaggaagcctgtttaaaactcagagttgagagtttttattgggggctgattatgtgttggaggctggtcaaaattccagactctcagaaaggaaagcaaagcaggtgttcactataaatcacaatgtttgtacaaatagtctaagcaggctgacacagaaggtgcaacttaacatgtagggaacatttcaaaatttcattttttagatgccagccaacaagcaggccttttaaaggatagcagtcttggacctgctatgttaactctttcctgcacaggtcgcatctcaaggtatgcttagaatactaagcacttccgttgtgaaaaataatgcgctgtattaaattcttaaaatagcaaatgcctactaaatatgagctaatgtatcatttctttccatttaggttctggctgaatacaagtttgaatttctgcaaacaatttgcaatcacgaacattacattcctctgaacttgccaatggcatttgcaaaacctaaactgcagcgggttcaaggcatgtatttgcattttccatcatttgagtttgtttttttccatgttttgctagcgctagtgtagtataatgttttctagttgaaccagtcaacttgaaggtaatttcagaattgttactatctgaagtccattaatgtttttctgcatttccttcataatatcagtaataatgttcatagtgtgaagaaatcaggtgtgttaatagattgctgcttaaacacagatgtcagatactagtgaaattactttctgtagtagtgtttgggatcttgtatgagactaaattaagaaaaagacatataaatgcatttctcctcaaagcatcaaaaaatgtaaaggtagagtaaaatggtaacatgtttgtgctaaatttatgaaatgccttcagttatctccattgctagttttattgaatgctttgttgtatagcactattcttatgttactatgttttttatttgtcccttttcttttcatatattaattagattttttttcatttgcggtggaccgtttgacttcagtaggtaggtttaactcggttcactctaaattagcttgctgttttagaaaacaattgatttgatgaattgctaagatggatgggggctttgtttgcttttcaaattctccctagccaaaatgaggctttagttaaagtacccagaaaatctaggaggcagtgtgtttgtttagttttaaaataaaactgagtgttgctagagaaatcaactttaaaacattttccctcaaaacacaagttcctgctgcaagccagcatagaggccatggatggggaactggaagttacttgttttttttttgtttttgtttttgttttttttttgtgtgtgtctcctctctcaggcttgcctctctcagatgctgtttagtgacaccttggccacaattttgcaggtgtagatgaaaccacctgattggatttattcaaatcaccaaaataacaaattgattaccatttgtaaaatctactcagataaagccacctttgttagtcagtcctggcccttgtgcatagaaggtgatagggattcacaaaagagcaagaccaatgcaggaagaaaataatctgccttggtctgtatagaagtatctgctgagtggtggttttagtgatggaattatagccagtgaaaatggagaaaaaaatatttttaaaccatagcactcctattcagctacccccttattcgattctgaacatgtatagctcacataattcacccaatatttatttataactatgaggaagtcaggaaaaagaagaggtggacagataatcaggatttaggattaaattggactactcgcagcatttattaagtcccaactgaatataaagcattgtattaagtgctgaacaggccaaaagaaaaatagaaaacataatccttcggcttcatggcctatctaattaaatagcacgggagaggaaataaagatagtagaaatctaccacagaaattactaaacttggctgggcgcgatggctaacgtctgtaatcccagcactttgggaggccgaggcgggtggattccaaggtcaggagttagagaccagcgtggccaatatggtgaaatcccgtctctactaaaaatacaaaaaaattagccgggcatggtggcacatgcctgtaatcccaactactcaggaggctgaggcagcagaattgcttgaacccgggaggcagaggttgcagtgagccgagattgcgccactgcactccagcctgggtgacagagcgagactctgtctcaaaaaaaaaaaaattactaaacctgatcacaatcccctataagtacttataaagcaagtcccaaccatgatattaacatctgggatttaaaatagactgaggatctagcctgggcacagtggcttatgccttaatcccagcacttcgggaggccaaggcaggcagatcacctgagctcgggagttcgagaccatcctggccaacatggtgaaaccccgtccctactaaaaatacaaaaagaattagttgggcatggtggtgcacgtctatagtcatagctacttcagaggctgaggcaggagaactgcttgaaccctggaggcagaggttgcagtgagctgagattgtgccactgagctccagcctgggcaacagagtgagactccatctcaaataaataaataaataaaatagactgaggatcttaaaggaagggaaagacttagttcgaagtgattattttctgatataaaatatttgtttttgagtgatgatggattggaatgaaatgagactgttttccttattgttcttatgtcccatgtatattttcagcccaatatataatatttactaaaacagtcaatactgtcagactattcagttgtttagtttgtcttttcccactttataagtataaatggataagtaaatcaagtattattacatagaatttttcaaatttatagttgtgacaaaatctcttcagctataaagaaatctgttaaaacgttgcaaaatatataattattttattgtagtttctatcctaagatttctatgagtttaaaagaatctaggggaaaaaaaagaattagggactttctttctgactgaaatgatcattaaagctatcgtttagcccaaaatatgagtgctcctgtcttgtaaattttgcatgcttattctagatgataaaagaattgctcagaatcattaataataaaaattatagctcttgctagcatgatcacatattattaaataatacagtattttaattataatcatgttttgaatattttcataaatgggttttaaatttcattgtactgcagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaaggtaaggatatccatgcagtcatcagtatcacactggtagagttctactatgattttttatagaagatgaagtttttgtagcaaggagcattatataagcattgaggaaaatttatttttgcttcaaatcataagttgttttttttttgagacagagtttcactctgccacccaggctggagtgcagtggcatgatctcggctcactgcaacctctgcctcccaggttcaagcgattcttgtgcctcagcctcccgagttgctgggactacaggcgagtgccaccacgcctggctaatttttgtattttttagtagagatggggtttcaccatattgtccagactggtctcgaactcctggcctcaagtgatccacccactgtggtctcccaaactgctggaattacaggcatgagccactgtacctggcctcaaaacattaggtttttaaaaataccatttgggaccgggagcagtggctcacacctgtaatcccagcactttgggaggctgaggtgggtggatcgcttgaggccaggagtttgagaccagcctgggcaacatggtgaaacctcatctctactaaaaatacaaaaattagccgggcgtggtggcacacacctgtagtcttagttactcgggaggctgaggcaggagaatcacttgaactggggaggcaggaggtggaggctgcagtgagctgagatcatgccactgcactccagcctgggcgacagagtgaaactctgtctcaaaaaaaaaaaaaaaaaatatatatatatatatagtttagttaactgttaaagaaatacactgttttctcaactcatacttaaagaataacataactgcttcatgattaagaatttttaaaaaatttattctgtgaaacatatgctttaatatatctttaaatatatatcatatgtaaaatatgtaataagtttttcttcttactgaaaaaaatgttaatgtgatggtgttactataaatagctgtgggtgtggctataaattttacatacgttacactgttgtctatgagtaacggtcacagctacagtttctatttactgcactaattttgttttctttctttttttttttttgagatggagtctcgctctgccacccaggctggagtgcagtggtgcgatctcggctcactgcaacctctgcctccctggttcaagcaattctcctgcctcagcctcccaagtagctgggactacaggcacacaccgtcatgcccagctaatttttgtatttttagtagagatggggtttcactatattggccaggatggtcctcatttcctgacctcatgatccgcccccctcagtctcccaaagtgctgggattacaggcgtgagccaccatgcccggcctatttactgtacttttaacatatatattgaaatcttactgacattaaatcctgttggcttgaaaaagtagagtgcaaactgtatggatttagaagactctaatttacttccacggtatcataaatcactctaggaaacataatattgtttcataataaataatttatccttttctttttacattccaatataaataaaattatgatgtcatttatcatcggtcattttggaaggctgacttggagcttttattctttttctacggtattcccatttgtcctttttaaacagaaaatgcctgccagtgacatctgctcacattcctttaattacagtgattttcatacatgtaaatcttgctagttttcttcatgtgattgtatcctaaagtagatttaactcctttgctttaagatgtaatttattgcttactgcagtttgctttgtttttgacacattataacatacctccacttagtgtagttggctcagttatgtgccattttcactttttgtgaatgttgatattgacttcacacaaattaactggtataatatatccaaataaaaagatatcttaaaagtcctccagtccaatcaagcttggtcaagcctttaaaaatgcattatcgctgggttctggctaactacttgcttatgcctgtaagtggggaaaaggatcttatgccacgtggaggaaaatgtctttagccatgattttaaatgattcactggaaaagtacaaaatgaacttcccctctctgaagcaaaaagttgtatatttctccactgccttttcacatgaaagagaaagaaaattggattttgccagtgggattctcaccacctagaggcagaattaaatattttatatcacaaatttggacacttttaacttactttttaaattcttagagcagtgtgtgtacacacgcaggtattgttacctgtaaataagttagacactctttgagtgtttgaggttttaaactacaggaaagattgaaatgccaagccttattactctttcaatgacttctgaagctctttcctctttgttcagaggcttcatacaggcattaaatgacgatagagttttctccataagaagtttgtttacttcgtgggcttggttaaccaaagtttcaattctagagtattggatgaggatataaaaggtcctttgtctgttttgtgcagtttccaggcagcctgtgtaagagttcatttatcaaatacatccaagtagagcatgtttcctattaatgatgacaccaaggtgagggattggagggagccttaagccctcatattttccatcagttctctaaagggaccccaaagtaataaaccaaaaaaagaaaagaatgtttcctatgaaaagcctgctttgagactcaactccctaatcatccccaccctttccagccaattgccactcctaagcccctgctcttaggaaattctggagatattgctggtccctgttatgtgttactcataaactatttagcaatatctctctcttttttttttgtgacggagtctcgctgtgtagcccagactggagtacagtggcacaatctcagctcgctgcagcctccgcctcccgggttcaagcagttctcctgcctcagcctcccgagtagctgggattacaggcacgcactgctatgcctggctaattttttgtatttttagcagagatgggatttcaccatgatggccaggatggtcttgatctcctgacctcgtgatctgcctgccttggcctcccaaagtgctgggattacaagtgcgagacaccgtgcccagccagcaatgtctcttgttataattaccatgagacatttttccttttcagaacaagaatgttcaatatctaacatttaccctggggcctgtatagttcttgtacccactacaagtaatgttcatacctaagagaactgcagattctacttctagttcggctgtgggcaaatcctttttccttttttgaaaaagtaatccacgtgcatggtgaaaaacaaaaatcaaaatgcctgtctcccattccttacctccacttaccaattcatctttccagaagcaactactcttgtgagtttatttatacttctattttatataagcacaagcctatatgacatatatgtataaaatataacagaaaccattatacatttttcttttttcacttaacaatacagcctgaaggttagatctaccgcattttaaaaagtagctgcatagtattctatcatatggatatactttattttatttatctaactagtcttctattaatagatacttaggttatattctctgttgtgcaggcaaaatttttaacatatttggcaatgactgtatgttttcctgtgttcctgcttccctgagagaattgtaatttctcttcccctagagatcactcattatcagaactaaaatggactcctatttagaagccataatattaataatagcagctaaaatttattgaggactcactatatgccgaacactattttaaatacctcacattaattgatatcattattattacccccattttaccaaagagaaaactgtagttaagtgacttgattgtaatcaagtagctagtaatgggagagctgggttttgcgcatgtctctaactgcaaaatctgtgctgtcagccactagctatactgccttttaaatctcaacttgggacattgaaaaattagagaaccaccagaaaaagggtaatcactaagtgaaaaatcttgacaccaaagtcatggaacaaaggaaagtaatgagagttaaaaggccgggagcggtggctcacgcctgtaatcccagcactttgagaggctgaggagggtggatcacctaaggttgggagttcgagaccagcctggccaacatagtaaaacgctgtttctactaaaaagggacaaaaattagccaggcgtggtggtggatacctataatcccagctacttgggagactgaggcaggagaatctctcgaacccaggaggcagagattgcagtgagctgagattgtgcctctgcactccaacctgggtgacagagtaagactcagtctcaaaaaaaaaagaatgagttaagatgattcatggtaactgtattcacatatttaaagggttgccatgcaaaagtagaaatagacttattctttgtagctccaaagggcagagctatacctaggaggtagaacttaggaggagtgtatttcagataaaggaccttcctaatagaacccatgaaacggcttgagttttaaagaagtttaaaaaactatttgtcaaggatacatgtaagggccattcattcctgccttcagcaggaagttggactaggttagtggttctgaaacatttatgcacatcagcatcatctggaccagtccagacctggtaaatcagaatcttctggtggtagagactattactgacggggtactatgttggaagaaagtctgttaagaagggaagggtttttgaaattcacaaatgaagtgcaaatggccaattaacacgtgacaaattgttcaacctcaatagtaaatgcaaactaaaacaatagtaagagaccagtaatcttctacattctacatattgaccattttgccctagagggccttatctaattctccagaaaaacctcctaaagtcatgaaagatagagggcaatgcttgtgctaccacagccactattttctctgatttgagtgtatatacatatctggcgaggaatgtctataagctgaggaaagaaataaatttgtataagaggtaccacattaattaagagccctggtggccagttttatttacatatttacaaatatatcaatctcccaagtcttaaaattgacttaggggaccaagttcatattattgtaattgtagctttaatggaagcaaaaaatgtttcctgaatgaatacagtaacttaccattttttcacttcttccacttactcattcattccttcagctaatatgtattgaccatctgctatgtgcccaggcattggggatgaagcagtgaacaagacagacactgtccctgctctcatgaagctcaacgctcactggagctgaaaaacaggaataatatcatctgctttataggccaacttctattttttacaaaaaccttttacttcatgtcattatgtttgagggatgtaatttgagtctgtatcatggataaatccaaaggccaacaaagttctgtggtaattagttttcagactataagtataaagagattcatgcttcagtaatttgttatggatgttagcctactttttagtctttaaattgatatatgaagccaactccatttatttgtaatatatacatattatatacgtattaagctttcaataattatttttcagaaccaacaagccaaaatagcacaattgtacctcccctttgttggactacttttggaaaatatacagcgattagcaggtcgagataccttgtattcttgtgcagccatgcctaattctgtaagtagtaatgtgtttctgttggagttttatcctattttattgaatgcatttggaattggggtcatatgctatatgatctcaaccttaagagttcacttttttttttttttttttttttgagccagagtctcgctctatcacccaggctggagtgtagtggcacaatcatagttcactgtagtctcaaactcctgtgctcaagtgatcctcctgctttggcctcccgagtggctgggactacaggcatacgccaccatgcccagctaatgtttttcatttttagcagagacagggtctcactgtgcagcccaggctgatctcaaactcctgagctcaaggaatcctcccctctcagccccgtgaagtgctgggattacaggcatgagccaccgtgcccagccaagagttcagtttttactccatgtacactgtttttcctaatacagtgctttgcaaactttaatctgcatatgaatcacctggggaatttgttaaaacaggtttttttttttttgagacagagtctcgctctgtcgcccaggctggagtgcagtggcgtgatctcggctcactgcaacctccgcctcctgggttcaagggattctcctgcctcagcctcctgaatagctgggactacaggtgcccgccaccatgcctggctaatttttttgtatatttagtagagacggtgtttcaccatgttagccaggctggtctggaacatctgacctcaggtgatctacccaccacggcccccaaagtgctaggattacaggcgtgaggcaccacacctagccaacagattttaattcaatagacctggggtgggacttgagagcatgcatttctaacaagcttttggctgcttctggtccaaagattgcactttggaaaacaaattccaagagaacaccacaaatcctttgaacgctgtgttttcgttcttaacattttctgttgttgtatggcttcatacatttattcaacttaaactgaacaaaagattctctacttccaagatattaggcactggggactaaactgtattcctttgcttctcctttcccttagtagtctccttcagcacttcttggtgagactcttttagtttatcacaattggtctgtgctttttttgctccccttagaattttaagaattagaaggaactttggaggtgatcagtctcctatttggcaaaacaaccttttgccattgtaataatttaaacattccttctcacattagacctaaaaggttttctatccactggtcttacttttgtcttctagagacacatgaaacacatctgttcccacctccaaatgtaccctttccacttgtgccttctaaatttttctccaagccaccaaatatctccactaatctgtcattccaaatcctttacttttttttttttttttttgagacagagtctaagtctgtcacccaggctaaagtgcagtggcatgatctcagctcactgcaatctctgcctcctgggttcaagtgattctcctgcctcagcctcctgagtagctgggactacaggcatgcgccaccacgcccggctaattttttttgtacttttagtagagacggggggtttcaccatgttggccaagctggtcttgaaatcctgacctcaagtgatctgcctgcctcagcctcccaaagtgctggaattataggcatgagccactgtgcccggtccccaaaaccctttgctttcgtggtcaccccttttccaaatatgcttcagtttaccagtaaccctattaaaatacaatgtccaaattatacactttatagtctgcccagtggactgttaacttctgcccccatccatgttctgtatggcccaagatcacctttgcactttggctggccacgtaatattgttgggtagcaggttaaactgtgtcatttacagcttcctctgcaaattccccctatgaaatgctacagccaatttgtcatgcctgtcctgtgttcctgaggacgttgcttttaagcttttctagtggcttgcttccctgtgactcccagtcatgtcaactggctgaatgtggatactacacctacctgagtgtcaggctggtctcactttacaaatacagtatctcatgcttatgctccctccacatagatttgacagcattatttggaaatatttcacttctctgtattctttgcagctcaagtttccctagggcttctggtcacacaccttcttctagcattgccctggttctaaggaggagaactgaatcatgttaagactttaccaggctgggcgccgtggcacatgcctgtaatcccagcacttggggaggccaaggcaggaggatcacttgagtccaggagtttgagaccaacctaggcaacatgggaaaaccccatctctaaaaaaatgaaaaattagctgggtgtggtggtgtatacctgtagtcctggctaatctggaggctgaagtgagagggtcacttgagcccaggaggttgaggctacagtgagctatgatcatgccaccgcactctagcctggactacacagcaagaccctgtctcagaaaacgaaaacaaaaaagactgtaccagttgcagctgtaccagttgcagctatctagaattatgtcacttggctagaggtcatggttacaacagtatgctagtagctttttttttttaaaaaagagtcacctaaatactaattactagtatctgatttagactttcacagtgagctttgtttaaaatcaatgtaacattttattctgttaattcagatttcttatcctatatacgaatttgtttaaatgacacaggtatcatattctgttacaggcatccagagatgagtttccatgtggctttacttcacctgccaatagagggagtctgagcactgacaaagacaccggtaattaaaccttttggagatgatacattgcgtgggtgtttagacatgtaccctctacttctcagtatttttgatatatttcataataaagaccatacatagcttgatctctactaaagtttaattaaaatctgacttatacttgcagtcaaatttatttgcctaggtttccttgtctaagcttatttagaacatagcttggcatactgagaaaatagaggataatgagaaaaatactggtttccactcttcttatctgtcaccagttttaagccagatactcccatctatgggctcaagtttccttgtctataaaattgtcttttaaattgtgtggctttattttacggcttccaaggaatttcttgtcattttgtacatgctaaagtgttttgaaaggtgaaaagttgcttcacttttacatggtttcttatggtgttttgatataataaacttcacattttagatgtccaagatctattccctacattaatgtctctacttaaattagttccgtactttttaaatatttctgacagttccccctcttgccaacaagggcttgacttttttttttccccagcttatgggtcttttcaaaatggacatggaattaagagagaagattcaagaggttccctcatcccagaaggagcaacaggatttccagatcagggcaacactggtgaaaatgtaagaacttaaatatataggatgaccctagtgacacattagcctgcaacaatttttttatagtataaatatgagcatctgtactcacctgtagtccatcctggctctgcgaaaagcatcccataattcttagatattttagcagtatcttcctatagtggcagctgctacttcaatgtcttaaactatttatagagaataaggcattcatcctcaagagttctaactctgaatatctcctttaaccctagcacgctattttagtgaggagaaattcaagtttaaaatatctaatgtgccttgttatttaaaacgaagcacatcctggcaggattaatgcagtctttcattcttttgtaatagagtaatgatattaatttgggaggaaaaaatataggtcccaaaattgacaatcttagggtcccagcatcacttaatcagaatatatcctcccaactcttctatcaagtcgtttcacgcctaccattaaagtttgagatgtgactgccttaaggcagaaagacctcattttagacgagtaaagttttgccatgttgttatgtaaaatcattgaatcgtataaaattatattagaagggactataagaacaataaattccaactctcaatttacaaatgaaaattgggattatgacttagaacaaccagctatggcaggaccatactcgaacccagattttctaatatgagcactttgtctcctatatcatggtgctcttagtgtacatcagcatcacctggagggcttaaaaaatagatgtctgggcctcaccccagggtgagattcagtaagtctggaatagggcctgctaacatgtatttctaagttcccaggtgatgttgatgctgctggttgggtattgttacccttgagaaccagtggactatacttccactggttccttgagcctttgggtaaacagtaatttattcacaaatgtttctcttttacaccatttagaaattgtgacaacaggtactgtcatagctaaggcaaataaaggtcagagaggttgaatgacttgctagtagtcacatagtagctaggcaagcaatcagaacctaggtctgtttgctccaagtaaaagttcttccttagtaaattccaccctagtcaatggtgcatccccagtttagctcaactgaaagtattagtttttaaattttttagattattgttattctattcatataaatccccaaataagtcagatcttgtcatgcttaatttctgatattttttaaaaagtcattaaataataggaacacatcagtactttgtagaggtactaattttgaagtattattgggtactcctaagtgtaattatcgtaatataattagcccattttttaatttatttatagtttttagaaatagggtcttgctctgtcacccaggctggagtgcagtgacacgatcagtgctcactgcagccttgaactcctgggctcaagcagtcttcctgcctcagcctcctgagtagctaggactacaggcatgcaccatcacacccagctaaattttttttttttttttttttgtagagacaggttttgctatattgcccaggctggtattaaactcctggcctcaagtgatcctcccacctgagcgtcccaaaacgctgggtctacaggtgtgggctactgcgcctggttttattagcccttaagatagattttctaatgtatgatttggaggttggattttaataaactctaaggaaagattcaaatgaaaaagtttaagatgtttcttatgctttcactccatgtaaaagctatctttccttaaatagccatgattattttaaaattttaccactaaaacacatggcatatgagaatgaaacacagtattcatggctatatctttgtgaagactccaaggtaatttctagtgatattactagctattactaggaaagaaagattcagcccattcaccttcaagttgtgatataaaatttagatttatgtttagaattttcccaaacagatctaatgataaaaaaagagttactgagttaaaggctgtggaaaattgtactgatactatttcacgaacatcctgtccttacagacccgacagagttctacaaggagtagtgtatcccagtataaccgcctggatcagtatgaaatcagaagcctcctgatgtgctacctgtatatagtaaaaatgatttcagaaggtgagttaccatcatattaagcatggactgtactagacatacaccctcacaggttcacaaattcatgcaacaatatttgatcatcatctggaggcagagcacatgcacattataaacagttatttggagactctgactttaaaatgtttcttaaattgaacttcaaaataggttcatgtcagtcacacaagttcgagtctttgaaataattttaacataattttgcaaatgaatttctaaaatgaggcaatggttttagaagtgctaaacattttgttttcatgcagagcatttaattcattaaatgaccaatgtaactgaaaggaaataataaccaccagaattcatatttaatacttcagcttttatttaacccaggatttgacaaataagaaacaaaaagacaggaagagttcttgaagggtagggaatgtcatcattatctttgcagcaacactgtatgatattgtctggtatcgcgttctttgtcgggctctgttttttctccttggtatagagccgtatttactagtgtcaccagttcctctttacactatatgatggaatacaaccgaaggactttcataaactgcatgtcctcgggaagtaaaagcaggttatttccaaataccacatttacttagacagttccctcccttctcttccttttcgcaatacttttgcttaaaaaaaaaaaatgcaaaaatggaaaacataaaagcacctgggatcatcatagtgattgctatcttttactcattttctatttttttatttttagtaattatttcgttttaaatattttataataatgcaggatgtaaagacataaaataagttgatatctaagtagctatagaaacattaaaataaatagctagatatgagtaaattctaaagttcattaataaaataaaaataactggaatattcaagttctaggaatgtacgatttagcataaatatcaaacattatgttgtggaatctggaaattgctaacatttatggagtttcttcttaaggcaatgaaaatgttctaaaactgtggtgaaggtttccttagtctttgaataaactataaactattgtaatattgtgggctatttatgtgggcatttttatgataaatgaatctctcagtaaatgtttttttttaaaaagaggcccaatctttatctgttctccactcccattgccacttgactagccttaaaaaaaataggtccaagagatacattagaaaaaaagcagaagtgaacaaaaaagcggttgaataccaccacagcccaaagaatgagggaaagagagagaaggtaggaggaggggaaaagctgcattgctgactagttctctcccctcctccactgtaggtctcacacacacatacacacacatatacatcacattctatactaaccagagacaagtctctggttgttatttttaatgtcatgggtaaaaccatgactgtttttgttttgaagatggagtctcactctgtcgcctaggctggagtgcagtggcaggatctcagctcactgcaacctccacctcccaggttcaagtgattctcctgtttcagcctcccgagtagctgggactacaggcgcccgccaccacgcccggctaatttgtttatttttagtagagatggggtttcacggtgttagccaggatggtctcgatctcctgacctcgtgatccgcccacctcggcctcccaaagtgctgggattacaggcgtgagccaccacacccggcccatgactgttttatttcttgtgaacttgatagttcctcttattcttgcaaatgttgaccatgcttgctcagtggcagtactctgtgccgaatattcagtctttgttaattaggttttgtagtcttctgctcttgctttttgattttaaaaagcacattttcaataactagtatacagtctatgtcacatctgtttatcttttatatgtataaagtcatgctgtatatctgtaaagtcatattcattttgttctaagaaatgtcttctagatccttctcaatggatgtattctaattactttgtcttgtccggtaaatattgttttagttactctatatgcatttaaatatttatctctttcaagtccacaatcttgaggtcctctcttggctttcttttttattgagtcataaacagtagcaactttaatgtcaatgaaaagatgttctatctctacacttttatatggattctggagaataaatttcattctctacttatagctgcattttattaattgacaaaaatttgctatttcaaagtcttagattcatttgccaaacattttcaggccttactgcttagtttattatatcgtgagaaaaggaataagagtcaggagttaccagttacgaagtctgaattgacaagaagactgttctgttggaaaagtaaaacattgttgcttccttaagagagaaggtggtggggggcggtgggggggggggtgaggggggtgggggggatggggaagctacttcctctttctttgtgactgtgtcttcacttttctctttagcccagactccaaaaagacactctcagtatcacattgaggcttatcggcaccataccctgcacttgtagattcattaatattctccgaagcagactgttcattggaaggtatctggttagagctatctctcactgcaaatttggtgttagaaggaatagcaaccactgctcttctttttgtactagattttaaagtagagtctaaaggcaagacattcaaagggattattttcttttcctttgcaagagggctatatgaggttatagaataatcctctaaagtttccagtaaactttcagatacatgagttgggtattctcctggggagatagcggaagggttccatgatgtgccaatctgagtttctttttgcggggagacctttgtttcaagtgtcccttttggctggccaatcttgtcttcatgaagattgaaaaaatcttgaaattcatacctcttttgaggactaagtgaagttgttaaaagagaacttgccagtggcttctggctggcagggtcttctatgttaggcttagtgtcattagaggaacttttcgcaaaagaggtctctggcacttcaaagaggccttgactaaaagatggagctggaaactctgaactttgttgcagttcctttgtgctcgtaggtttcatctgcttactttgtgactggcttatcgatttgataggcacatgcctctgccttccttgtgcaggctccctgactgaaaaatctgacatagtcatttgactaccagaaacgaagtcatcactaccagaagtctgaaattgttgttgcctcattattattttagaaagccttttattttcttctcgtaatttatttgtttctttagtgagttccgcaataaagaaaagattttgttgttggatttcataatagtctttctctagcgcaagcctgtatgtttctgtcattgaacagcagtcacaggtttttgcctttaactgatctttcaagtcattaatggtgctctgcaggactctctgctgtttagtcaactctttaattttggctgtggagcccgtccgcctcccgtctgacaatcgctgtttcctcagacttgttaattttgcctgtagacgccgcagctctttatcatggagctcttttagcgccagccatgtttttttaaaattgtcagattccaaatcacatacactaagccgtgatgattctcttcctgaagatttcttacaacctctcctccctcctacaccctcgttccctgcctgcatcatgtttcacagatttggaaatgggagggatggcctcgtcgctcaacaacagtgccgttaagaaaatggcggacttgcagtggattggagctagttcgctgtgagggcgagcacttttacccctttcacagaccttctccgaagctaccttaggacatggggcgagggagatgggtgctcaccgttggacgcaaagtcccaggttttcgctggagaggaggcaccaacttttcggctagaagagctaacccacaggagagggaggccagcaccctcaggcagtggcgcagcaagctgccctttgaccggaggccggaaacgcagggacttctgggggggaacccaagcttctgtgagtagacacccagtggcagataggcgaaagcggaagtcactgctagcttgatatatatttttttaatttaattttttttagatggagtctcactctgttgagcccaggctggagagcagtggcgcgatctcagctcactgcaacctccgcctcccgggttcaagcaattctcctgcctcagcctcctgagtaactgggattacaggcgcgccaccacgcccaactaatttttgtatttttagtagagacagggtttcacgatgttggtcaggctggtctcgaattcctgacttcagatccacccgcctcggcctccgaaagtgctgggattacaggcgtgacccactgggcctggcctaatttttaaaacaagtcaaattttgagtctattttcagttttattcttgatgattagcattttgtaataattgaaacctagcaatattcgtggtcttataaaacaattggaaaattggaagtaactaagtcgacctcccctgttccctcatcctccttgcccctccataaagccaacattgtcttgtcttccatctttatcattgagaggttctagctcagttgggaattaagtcatttgcctgcttttgtgacacctatgcgatttttacagttagaggagggtctgctgacaccattagctccatcaaagtaggataaaaaaggagtggaaagtcaagtggtggcactgtttgttttgttttgttttgttttaaatctcactaagtaggtgtgttggggaagaaatgggtaagaaagagaagtatatgtgatagatttaagagacttttgtgtctgaaatagttgttccacagatagataggacatcagaatttataatgcaaaggcagagagaaaaaggaaagttatctgtctctcctgaagtttaaaattctcttttttatttttattattttttttgagacggagtctcactctgtcgcccaggctggagtgcagtggcacgatctcagctcactgcaacctccacctcccaggttcaagtgattctcctgcctcagcctcccgagtagctgggattataggcgctggccaccacgcccagctaatttttatatttttagtagagaaggggtttcatcatgttgtccaggttggcctcgagctcctgacctcaagtgatacgcccaccttggcctcccaaagtgctggattacagatgtgagctaccgcaaccaggctgaagtttaaaattcttaaacctttttattcacagagccctctgagtagcaggcaacggcatttgaccttctcagaaaaatgcacataaacacaccatctggcataaaattttagggagttcattcaaaacacctcatctaaagtaaaaacacagcaacttcccttactctgtcttcagaaatgatacgaagattgggataagcgacccaaaaggacatacacaaagcacataaaaaggatcattgatgctgaactaattaccaattaaatgatatatttggaattaattcaaaagaatacagagtgtatactgcgcagtgggaggggagaggagaatatagatgaaacaagattcaccttgagttgatagtccttgaagctacataggacttggggattcactgtgctatttgctgtaattatttcaagatctaacactttatttattccattttcagatactctcttaacttactggaataaagtatcacctcaggagctcataaacattcttatacttttagagtaagttatattaatttatcttcatatactttccccttatttggggagaattcaactgttacaattttttctgtttttaatagcttatttgctaataatgtagaaaatgttaaattattttgataatatagagcctgacatagaggttctttacctgcagacagaagaaaaatgtgaacgtggaatactttgtatactgctgaaactctagctaataataaaccatctttaaagcccagcaaaaggctttctgtgatctgaaaaactagaagtagtatcatctgtcgtgcatcattcatttggaacagatgctggattagtggagcagtgtaaatgattggaatttagaatttgtactttcatgtagagctgagtaattctacccactgcagaaatgtgtctgtgtatttgtgtgtacacacacacacacacacacacacacacacacacacgtgtatatgtatgtattccaagactcttggggggaaacctagtctggacatgggaagttgtcctatatttcatcctgagctatttttatatgattattggaagctaaaagaaaaattagagatagaatgaaatgcaataaatttttaaataaatagtacacgtatatgatttgtatgtgcatgtctacaaaaacaaagcatatcaatacaaaacccttggattaaagtcttacaaacttttacggaaaatgtcagaagaataaacagcagttaagatttttttttaactactgtaattgtactgaaatatttactaatgaaaatatctgatgttggggatttgctttagaaacacaggggtagggagggtggagggatatcaggggacctattcagggcagaggtcaaacaagaatagccatgagttcaatcattgttgaatctgggggatgattgggtatgtaggagttaactatggtactctccctacttttgtacgcgtttgaaatttttaataatataaagtattttaatgctattatttaaaatgtagaaattgccccaatttttagtgtggaagaaccttttagagatattattgactatgctggcgggccaggcgtggtggctcacgcctgtaatcccagcactttgggaagctgaggcaggaggatcacttgagcccaggagtttgagagcagcctgggcaacatagtgagacctgatctctacaaaaaataaaacattagctgggcatggtgatgtgcacctgtggttccaggtacttgggaggcagaggtgagagaataatttgagcctgggaggtcgaggctgcagtgagccgcgcatgatcattccactgccttccagcatgggtgacagagcgaggtcctgtgtcaaaaataaaaaatgactgatggagacctttgctatgataagttacagagcataaagggtgatttgcattgacaggttttttaaacctgtcattaaaattgtatatgaaaacatgatgtaattgtagcaaataaatgtagaaagagaatatggcaagcccgcaattaattatctatgtatttctgtatagcaaaacacttatcattataatatgatttaaataggctattctttgtaacttatgacttttaaaatatcacttgttaatctgtagaggatgttaatatattactaacatgctattgtttttctttctagagtatgcttgtttcactttagatatatggggaaaagaaacatagcaaggtaattcccatagcactgcaatttctactttttccttctcttccaacagagggcaatcttagtcatgccatgtaaaacctaggttgcatactttgagttaacattgggataccggtgatttagttaacatgtcccaattgaaagtttaaacgaatgggaacttttacattttcaagcttcccaaggagtgatgattaaagtgatatacagagtttctaccttgtgagatgcttatcttttctaaaggaatccagaagaggctagatccaggggaaggcaggaaatcataaagtgaggacaactgtaaggtctgtatttttgtctgaaaactatcaatactcacctcagttactaaagcaaatagaaatccccaacagcaattgggacataaatgatacattatctatttcctctttttgccatgtaagtcctagtgaaataaatacttaaggaaatatttgagagattctaaggtgaagaaggttacttgcttatttcaatgagatgtattttaggggtagagttagtcattaaaggagctcaaaaacagttttaaaaaatgtttaatttttaagaggctgtgtggatggggattactgttcagtctctggaacgtcctaaggataggtagtttgggtggtgagggttccaatttcaaccatgttttcccataagttggagctggtatggccattgttaccatgaacctcagtctctaggattctgtcaactctcccactacgtttactagaggataaacaaactatttcttccttagtccatgtatgacccagttgtaattttttaaatggaaacaacattaaagtaaaacaaagaaaagtttgttcatcttagcaatggacatgcttacagagtaaaaatttctaatccaaacttacctcaggttcagaaacagattagattggcattcattcttgaacatctggctctaggagtttcccctctcatttcaactcttagtgaacctctggctgtcttcttcccactcttgcccttcctcacctcctgtgaaaagattaaatcttattggagtgttggccacttatctctgatgtttttgagaagaaggagggaagtggaagctctttctaaattccttaattatattcatatatgctattttaaagatacattaaaacttcatccagtttctagtgacacttcatttaatccttgagtgtactactatgtttatgtggaaacctaattttttttagttaaaaagatgataacattgagatatgttattagagcactccagttcctgactttaaaatttattttagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagtaagtgaaaatgtgtgtgtggtacccatttgaccttaaagaagtcctggtttaaataataaaaactgaaggtgatggataccataaataccttgatcattacacattatatgcatgtaacaaaatatcacctgtatcccttaaatatgtatgaagaaaagaagtcctggtttaaattgccaatatgatgggaaatgatttcccatacatgtgtttgcatctctctgctatgtatataatcaatttcatcatacatgactataaaatgataaaatacacatggatttttgaacaattttaggtcatgatgttttcttcttagtgttaaagaaactaaatttttcccatggaattgctattctcataatatttttatattgagtattcttcattcctactgttagacttcaatgcaaatattgacatcttaatataatagtatatgtaatatttgtttagttacttttggtcatttaatgattagggaatgaacatgctgagttgactgcagaaatcggtgaatcctaaatactagtttggcaaaggtgtatttcagacaggttgaagtattgacaaggcaaatagggcaaggagagaaatcttgcccaactgcggaagctagagggttatataaatggaagctatcctatgaaaagcaaatattaataacaactcaaagagtgagaatgttttgtttccacacagtcctctgaaggtttcagaaaaggaagccagcaaaactggctttgtggtaagacctagtaataaaaaataatgttttgctagaccctgaactaatagactcaggacctttaaatctgcatgttttaaagccttcagcttcttgtaaaaatatgatgaaccacttccttcagttgcctccaagataccttgttttccttctgatttagaaacaaatgtcatataattggcataattgaaaatgtctgaccatagggcactactgtttatctgtagctgaatttctatttagtggtttctcatttttacccacataattagtggcatgacttagaaggcctcccacattatttcctagttacatcgccagagttcatcactgaaaccttgtctccaaagaggtgggcacctaattatgtcctgcagagctgttgatacagaactgtaatgaaaactaatgaaattgattaacccagactatatttgatgaaggagttaaatacagtatgacactgtgagccctcttttttttgagacggagtctcactctgtcacccaggttggagtgcagtgacgtgatctcggctcgctgcaacctctgcctcccgggttcaagtgattctcctgcctcagcctcctgagtagctgggattgtaggtacgtgccaccatgcccggctaattttttgtatttttagtagagacaggtttcatcatgctagccaggctggtcttgaactgacctcatgatctgtccgcctcagcctcccaaagtgctgggattacaggcatgagccaccgcacccagccgagccccctttcttgtcttaagtctttgggtagaaagtcattcaacaccattatgtgcatcttcgtgttgggaaaagtttaatttacttttttaatcctaggttctacaacaactgaagcagacattttccaccaggcacttcttgaaggcaatacagctactgaagtttccctaacagtactagacaccatatcatttttcactcagtgcttcaaggtaaaaatgaagagttataattcagttggtaccattgcaaagtaacattatgcagaaattacctagtcaatgtggggtagtacactgaaaaaggctggcatgaatagtcaggaaatgtggatggcagttctagtttggttatcatgtgaccctggaagtcactgagactcacttgtgtcatccataaagggaagggagtggactaacttgcccttaagctctcttctacctcttaaattctattagattttcgtatttaaaaacaaagtttccatactttaagtagccagcaatttttagcccaaaatatgattggatctgtttgcccaaatacccattgtgatgagatgtcctgtcagggtagatgatgtccgggcagtctggctggcttccctaggcgcgcacttagtgttttttctcagatgtttgcctctcagtgcaaatcatcattgctatgattttaaaaagaaggtaaaagcagttatctagcaggattattggagggggaaatgggataatggacgtgagagtgctttgaaaagtaaaaacggtgtgaccataatgtaagaactcaaaggtgaaaatcttgcttgctttcacttcagttatacagattttttttttcctttttcccctcttctctaagtaattaagttaattgcttcagacctcgagattttctatggaaacctggcctgtgcttttcaaagaggcttataaaggaaaattgaattagatactaatataaaataggctgcagaatacctttaataaataggctacagatccctttatgaagtattaggtttgttctatattaaaatgcaacacaactccatgtttcatcgtgccaataactaagaaagccattagatctcatgatgtacattgtattccttcctcctattctgatacctctaatttatttaacaaacatttatatagtctcttggtagatatcaggcactgtcctaagtgctttacaaatattaactcactttttcattgtgaggctgggaatgagaaaggggagtgatctttttgaaacaatggaaatgttctaaaattggattgcggtggtcacccaactctgttgccgaatttactaaatgtaatttaattgtatacctgaaactggtgaattttatggtttgtaaattatatctcaataacttaaaaatacaaatatgaactcacttttaatcctcataatagccttatgatgtagatactgttattattcccttttgataatggggaaactggggcccacaggaggttaatgtcaaatagctgggcagtggcagaatcaggattgagatctaggccagttataagagaccatgattctagccactataccatgccttgaaatatactaaggaaagtgccagaaaaatcaaacaccattcagggattctggctgtcagtattatcattagattgttgttgttttgggttttgttggttttggccaagctgtaacctgctggttactttcttgagggttagcaggatagggctggagaaattaaccattgctgattaaaacaaagttgacaaactaaaaggtatttctctacaatttgttgtttctttgcaagggacatttaaacaatttacatagtctgttcaattgtgatacctgttaattatctctactcatagagggcttattttttcacaaatggctaaccatatactaaacatacttttaaagtaaattagatcataatctaataaaatagaactggtattttccttcattcatacattacaatatttagtctctcagaaatacaaaggctgatttgcttgtattcattattaatttattgatttcttaattgagaagcaatatggtataggttaatagaaaatactcttcccatactagtcctgtatattgctgtgttgcattgaaaaaaaatctacctgtttaaaatgttgggattaaatattttagatatcatgtatgtagtagttgtttgagatttccaagttgaaagatggcacaaatattttgaaattatatgcaagagccttttattttcctgaaacttccaaacagtggtttcataaacaggtattggtgaaatcagttctgtcattctcagtggggcataaaccatattttttaatgttttatagacccaacttttaaataatgatggccataacccattaatgaaaaaagtgtttgatatacatcttgcttttcttaaaaatggacaatctgaagtgtcgctgaaacatgtatttgcctcactgagagctttcatcagtaaggtaaggacagaagcttgggagcagccggtgggctctcttcattgcaaaaaggaaagatgggacaatgggggtcattgtggtgacatatacaatgccagctcatgaagccattaagtactgcctttgtaaatagaaatacagaacaacaaagcacacacagagggcctaccatgaaccccctcaaatcagaagctactttttatttcaccccatcataccttcccttttccattaagctcctttgaagaatatcgttttaaaattaccaaacctgccagttctctattttgcttctttttaaaagtattgtcatgttggaggtatataagccatgagtgcactcatgtctaaacactttgaaaggatccaacttttgtaatcccagggtcttgtataatatcttggaaatggtaagcactcagtacatgttcaaatggatgaatcctgcctttcaatgctagccataactgagggccctaaatgtgcagtccacttacctcagctaaacaataacctcagacttggcttttaggaagaaatatgactgaaacagacagcaaagatttattttctgtgctcaggggctttttaaacttaagaataaacataattaaccaagatagagccaaggttatggaaaggcacagtccagatcttccactggtttatgtaactacaataagacaaagaaattcagtttctttatttgtgtaataggctagctaagctttgaaaactttttgccatcctcattatttagatagcagccaattgtgtttaatagatacagaaattagatgaatttgaagctttttattgccattctttaatataatttatgaattaatctatgggaagccaagttcaacacaagcatgttacaaaaactaagggaaagagattcagaactaattcatttaacaaaaactgtaggtacttactggatatagtccctaaaggcttattgtccagtagagggaggcacacacacatcaagatacacatacacagaaacaaataccatcaggataaaataagtctgtatagacctctgggggtgagcaggagaagaactctaatttagcaaaagtttttctgcagcaacggagctaggatttaatatggattcaccaagagatgaaactaaagatgtaaatggagtacagatcatgtggactcatcttaagagttggatttcatctttcaggcatcaggtagtcatggaagggttttaagcagggaagtaacacaattatatttgtattaagagggaattggtaaggactggggaaaatctctttaaaagttgtgttgaagaaggattggtgacaatgtcaaaggcagtaaaaagactagttgcagtaagctagataagaaatgagggcctgaagtaaggcagtgacagtggatatatgaaggatcaaaggcagatgagacatgttgaaaaaggatttacaggatttgatcatcagtccactgacagtatggtggagtgtggtggttgatgtgaaatacaggggaaagactacatttgcagtaaaagttaatgagtcctgttgaatttgagtgcctttgggacattaggatatatggatctttgctctggagagggatcagattggagagccagagttggagtcattctccattcatccatactatatttattgaggaccttctctgtgtcaagtgctgtactaggtcctgtagatacaatggagatacaaaataaatatactctttgccctcatgaagcgttcagtcttagtggggataggggagacagaaaataaataataaaagaattagtaatcatgagccgggcgcagtggttcacgcctataatcccagcactttgggaggccgaggcgggcagatcacctgaggtcaggagtttgacaccagcctgaccaacatggcgaaaccccatctctactaaaaatacaaaaattagccgggcgtggtggcgggtgcctgtaatcccagctactcaggaggcggaggttgcagtgagccaagatcgcgccactgcactccagcctgggtgacagggcaagatttcgtctcaaaaaaaagaattcataattattatatgttctaggaaggaaacaaacagtgtactgagacagtaaatgatttgtgggagataatcttatcttagataggtttgtcacttttaaaatgagacctgaatctgtaatcccagcactttgggaggctgaggcgggcagatcacgaagtcaggagttcgagaccagcttggccaacatagtgaaaccctgtctctagttaaaaaaaaaaaaaaaaaaaaattagctgggcatggtggcaggtgcctgtagtcccagctacacgggaggctgaggcaggagaatcacttgaacccgggaggcagaggttgcagtgagccgagatcgcgccattgcgctccagcttgggcaacagagcgagacttcgtcaaaaaaaaaaaaaaaaaaaaaaacacaacaacaacaacaaaaaaacagagagacctgaattattgaaaaggggccagctgtaaaaagagcttaaagaagaactatctagggagaatgacatacatgtgccaaggctctgagttgggaaacagtttgcagtattctgagaactaaaaggctggtatttttggagcatagtgaactagcgggagcatcaacatacaagtggtagttgaagccatgggagtggtttgattttccctggagggtacattgaagaagaagaataacaacaacaacaaaaaaaatcaggagcagaacattggagagaaacaacgtagaagggaggttcaaagacgaatctgtaagggagatgagagggagcagtcacagaggtgggaagaaaggtaagaaagaaggatatcatggaagccaaagaaggaaagagttccaacattgtcatgacgtatacggagtagtcaaataagaaaggagaaaagaggtctgttagaattggcaattaggtcattgatgattttagccattgcccactcagagaagtgagtgatgtgggtagaagacttagtgtagtgatgagctacactatagctatgatctcccttaaatgtttattttcataccagagtatctgcttcatccagagttagtttagtttggtgaaattattagcgagatttcccaattcccaatcagaaaacatttattaagcattcattatctgcatagaattacacttggtattaaggtgaaataaagggtagattcctatatgtgggtctaaattcaaggttcctaagaaataatttttaaaagatgtccctctagcttcactctctgaaaaacatctattgtgtatcctgaagcagcttgttatttgcttgcctagacctaaaagcatgggaaattgtaacaagtctgttacctgtatattgtgtcttccacaaagcagactgaatacattcttaaaggaacaggccacttgtctcttttgataattagtcactttcttactccttttctatgctaaaatgtatcttaactatcagtgtttatgtgaagaggatatgtgtgtgtgtgtgtgtgtgtgtgtgtgtgtgtgtgtgtgtgtgtgtgtatctcctatatcccatttgttaaaagatgaacttcacttgctgagtagattttagctataattttctcagcacgttgatgttcacaataaaggaactgttgaaatataaagcaaaagagtaagtaatgaaaattgaccttcccatttttaagcccccatttgagacccatcattcatcatttcaggcattctttcaaaacatattgagaacctgcttactgtattatggcggtgcaaaagtaattgctactatatcactatatagtggcaaaaaccgcaattacttttatatatattatattattatataatatattatataataatataatatataatataatattatatattatatatgttattatatattaatataatatattaacatataatatatcttatatattaatatataaatataatatataagatatattatatgttaatatattatatgtttatatattatatattaataattattatataatattatattataatataatatataataatataatatataataattaatataatataatataatatataataatatataatatattataatatataataatatataatatattataatatataataatatatattatattattataatataatatttaatatatattataatataatatttaataacatgtaatatataatatttaataatatatcatgtattatatattataatattatatataataaataatatattttataatatataataatatataatatataattatatataatatataataatatataatatattattataatatataatataaattataatattatataataatataatatataatatataatataaattgtaatatatataatataaattgtaatattatacaatataatatataaattgtaatattatataatataatatataaattaatatataataatataatatataatataatagtaatatataataatataatatataatattataatattatataataatataatatatatataaaagtaattgcggtttttgccactatatagtgatatagtggcaattacttttgcaccgccataatacagtaagcaggttctcaatatgttttgaaagaatgcctgaaatgatgaatgatgggtctcaaatgggggcttaaaaatgggaaggtcaattttcattacttactcttttgctttatatttcaacagttcctttattgtgaacatcaacgtgctgagacaatatattattatataataatatattatattgatatgttaatatattaatatgtaatatatatatatttatatatttatatataacataaattatatatattatatacatatatataaatatataatatatataatatattaatatataatatataatacatatataatatataatagatataatataatactataatatgttgcagactctcgagctcttctcagatctatagcatttatattcagtacttctacatctttgtaataacttatatactgacttaagttctattattatcacatgctggtgtttatgttaactagttcaggctctctggagagcagagcctgccttatgttgattttgtatcctcaaagcccccagcatagttttaggtgaggatatagagggcacttgatattctattgattttatgattggattttaaatacttatttctgttttccctgttctttagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacaggtcagtgaaaataaaagcgcctcttcatctttcttctcttcaatctttaacctctagatcaagatccagagccacccaatccagtccaatacaatgtggccatctagcacttgatgtgtggctagtctaaatttagatgttctgaaagtgtaaaatatactatggcttttgaagactaagtatgaaaaaaatagaagatctcaattgttttatattgattatatgttgaaatgatatgttgcctgtattaggttaagtatattaaaataagtctctttttagtgtggctactaggtaattgataattacgtatgtggcatgtgtcatatttctatggaatagagctgctcctgagcagagaagagcataggctttatttcaaattttattttattttattttattttttgagacggagtctcgccctgtcacccaggctggagtgctgtggcatgatctcggctcactgcaacctccacctcccgggctcaagtgattctcctgcctcagcctcccaagtaggattacaggcatgcaccactatgcccagctaatttttgtatttttagtagagacggggtttcaccatgttggccaggctggtctcaaactcctgacctcaggtgatccacccaccttaacctcccaaagtgctgcgattacaagcatgagccaccgtgcccagtctctagtttaaatttgaggactgccacatactatgtgacctggagcaagttacttccttagcctctcagtgcctcagtttctgcaaatctggtggggtaaatattgttacctagctcataggatttttatgaggattaaatgagatgattaaataacaagcttgttagattttacagaacagataacacagtttatgtttttcatgctccagtatgcccacttattttaaaaatgagagatgtgtcaaggtttagtggaaagcattgactttggaatcaggcctacctgcacttaaatcatagcttaaatccttacatgccctgtgaccctaagcaagtcactcaatctgactgaacctgttcccttatttgtgaaatgagactgagtatttcactttgcagagttaccctgaggattaaaataaggcgtgtatagtgcctatagtgcctgacacaatgtgtagcacaagatagatacttcctacatgatagttattattcaacatctccatacttttgggtttattggatgaaatagctctgaactaaaccacaattgggactgcttgactcagtagccttcattgtaatatgggaaatccttggtcctatttatatctttactgtcatggtctgtcccattagagttgtttactggagataagattattagtggggaaacaaccataagcagcttgttgaaaaatgtcatcaataatgtgaaaatctaataggaatactgtgtatgcttcctgtaaaagtctgctatataattacttttgcatgttagagtcagccatcattacacattaggtcctttactatttgcttttatatgagatggcatttggaaacccaccttcccctagaacattgttctaatttgtgtgccaatatacctgaaattcccccattggtattgattcttctgggtcaaagcatcagttttctttaagtcttttattcaaatatagacaaattaataaatatgaagacttagaacactgtctggcacataataagtgctcaataaaggattaactagtactctaatggttatgatctctttcatcctctacaaagtagggatttttatcataggcattttacagatgagaaacatgaggcacagaaaggttaaatagcttttccaaagccacacagtgaattattgataaagtcaagatttgtatctaaggcattcaactctagagcccatacacatggctattactgtatcttgcttcctaggaccagtggtaaagcatccagccattaacatcttagtatgaattgttttggcattcacccaagggagactgagagatttaaaagtcccatcaaagacagtggttcatgcctgtaatcctagcactttgggcggcataagtgggtggatcacttgagcccaggagctcgagaccagcctaggcaacatggcaaaatcctgtccctacaaaaatataaaaaattagttaggtgtggtggcacacatctgtagtcccagctacttgggaggctgaggtgggaggatcacctgagcctgggaggttgaggctgcagtgaaccagtgaaccaagaccgtaccactgcattccagcctgggcaatagagtgagaccctgtcccaaaaaataagaagtaccatcaaagtccattccataaacttctgttaaactaggtaaaccctggtcaaaaacaaagaaagttgctgaggcactggacttggaagtccagccaactaaaatagactagtgaaaaggaatgagaaatcatcaaagaaaaacatgatttattctcacctttgccacagctacaacctagaaagcatatttaaaatggagacctgactaccattgtatcagttcactattatgaaaatagttttagatctggctatgctatgagttttgaaaaattgtttacgtctaaccaagaaagatcctttaaaatttgaaatagggcctttcaagttactatttcagcagaagaatgtaaacccctcatgtatgaagggtacattatgatggtacagtgtagaatctttaaaagaagcatttcatgtgagtgcttatatacttataaaatgatgagcatagacagcatttgttcaaaagttatttggaaaataatatttacttcttcccacagataataattgctgtaagccaactgatagctgatgtagcactaagcggaggatcaagatttcaggagtctttattcattatcaataattttgcaaatagtgacagacctatgaaggtatgttctcatttcagataataaattagaaccacctttgctatcagggaagtttaaactcttaaactgtcattggattcacaacttttgttagtatagaatgtacggaatgtgagttttatgagttaagggctttgtcttatacatcactatatctctagtacctagaacactgcctggtacatagcatatattcaatatcagtttagtggatggatgaatgaatatactatgtattcatagttgttatggcaagtcgaatctgaattttttttttctgggcttcatttccaaacttgctcagaaaatacatagatcctttatttcttaacaattgtcaccacttttaatattggttaaaaaagcactgaatttgaaatttcacaaaatttcacttagaatagctaacagttgcctgatccattgccaatggatgagaaatggcacagaagggattcattatttgatggttttgtgagttttgaaaattatctgttaacaccaaggctgtcactcttaagcaccattttgctgaggccaaacccaagactctgaccactgttccactttctttcctatatgcttaaaacttatagcactgtaaaaattcatctgttgctttgttgcgtagagtgcaggttctgatcttcagtgacacatgtatacaagggaagaagaatcctttgccaataggacttttcctcccagaagaatgaatcatccccattcttgggaaaggtcatcttccagcacagtttgacaacattgtgtaaaatctgaaaaagattaaaagctcatagtcacagcatatttgatgtttggatgtgtagaatctaagtaccaaaaaatattcccataggaatgttgcttgtactgaaaaataacagcgtgtagtgccagccgctctcaggctgggaaagtttgctttccagccagttctactagttccgcaggggatcagtatatgctccagctaatcttgtgagcatagaaacaagttacaccacttatgcttatactctaaggaattgtttttaccagttgttaccatccttagtactatgttatataggtagattggtaagtttttctaggtaaatggggcttgtatattctctccttgataggaaatctttttcttttccatatctcatttatgaaatgacttagttttattctgttatggcagtcattaccaacaaaccctattacgaaaagatacagctttcccctggtaaatgggatctctattaatgtatagaaaggaactttatgtatataattattatttttaaagggagtcaaagccaggtaggtattttttatttctattgtatttatttatttacttagagacggagtttcactcttgttgcccaggctggagtgcaatggcccgatcttggctcactgcaacctccacctcccaggttcaagtgattttcctgcctcagcctcccgagtagctgggattacaggtgcctgccaccacgcctgggtaattttttatatttttaatagaaatgggatttcaccatgttggccaggctggtctcgaactcctgatctcaggtggtcctcttgcctcggcctcccaaagtgctgggattacagtcatgagccactgctcccggccaagaaggcagtgtttcaaaccatttcccccacatattgtgtttatattgacaagctccctaacccctgtacctgtctcttcctcatcatctctgaatcatatagataattgtgattactcctgtgggggttaagaggatgcaataggacttccttagcagtggctagggtaaagaggaaactctggtattcttggtgccaaaaacaaactttgaaagcttaatgatctctctaaactttctggaacgttctgtgattcatgacctcccatttgtgtaaacagaaatttctgcagtatggttttcaccttagtgtatgtggtagttagtggatggagtaggcatgcttatcagaatggaagagtggccaagagcaccagctctagggccagactgcctgggtgaaaatcctgtctctaacatttaccaattttgagactttggtcgagcatttaaacacttttttataatagtgcttaactcatagggttgtcgtaaaaattaaaacatgtaaagaacccagactagtgcttggcacatagtaagctattagtttttagttactgttacaagaaaacggcaaacaaagatcactcccatggctgtgcaattcacaatggaggatctgggattcaaagccaggtagtctggctccagagctaatgcttttatgtcctgtgaatgtactgccaccaaggttagagcctttgaagcctgggctagttacatatttaaaaaataatttatttaaaattatttcagtgtactatatgcaataccaagaactgtaacaggaagtgaaaatcatatgtcctcagcattggatgacaagccttagagcacatcgatattgttgttcaacttgtcttttttgtttgttttgaaattaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggtgactacttaaagttttgttctaaacagcccttcaaaacaccttgagcatgttctgacagttctttctctgtcatcctttttcaggctgcgatgtgttatgtccatgtagcagctctagttgcagagtttcttcatcgaaaaagtaagatatttctgtttttagagatggggggattttcatttagcataatagttttttatctttgtagtttagctatgaatatgatataatagaacactgaaaaatatgttcacccttggccttattcagtgttaaaaataagctgttataaaagaagactggattgtttgttgtcccttctgctttcattagagattacaagaaaagttaaatagtacagggtggccaggtgcagtggctcttgcctgtaatcccagtgctttgggaggccaaggctggaggattgcttgaggccaggagtttgagaccagcctgggcaacagagtgtgatcctgtacctattttaaaataaaatataaaatataaaaaaaaaatagtacagggccaggcctgatgcccagtgtttattttccaagactgtccctccctggaagactgccacaaattaaactcttctcaaggctcaagtcgggataacacagattatttgtttccccgtcatgtgtcttaacatcaccaaactgcccatagactatgtctctccagccactttagtgcagtgatacctgggtactaaaagggagtcatactcttgaagggctttaggtccagcagccctggattcctaatttaagattcctaattcaggaaatctacttggaagtgtccctttccataaacagtattgttggctactgctcaacagtattgttgaacaaactgcatctgctcaaatagtaacccagttgagttaggtttaaacattgattggcaatggagctggcaaccaagaaatctctatctcaatgtccaagctacttcctttaaggcagtggaatgagtaacaatacggcaaaatgaaaccaacttattaaaggagtcatatcactctggcttcagctgtacgaacacaaccatattttgttttattttttaattacagaattcctacagttaactgtatatctatcatttcacactgaggctcagtgtttgattgcctcatataacacccatgtggagaatctttttctaaaaagattcttggccgagtgtggtgactcagacctgtaatgtcaacactttgggaggcatgggtaggtggatcacttgagcccaggaatttgagaccagccttggcaggaatggtgaaaccccatctctacaaaaaatacaaaaattagctgggcatggtgtcacatgcctgtggttccagctacgaaggagggtgaggtaggatcatagcttgagcccaggacactgcacttcaacctgggtgacaggacaagaccctgtctcaaaaaataataaataaataaataaataaataaatgaataaataaattttttaaaaaagattcttcttaagtaaaatgtagattcattttacttatattttaaattaacactttctgtctgactctggaattcttttgaataatctatgtgtttgatatactttagttttctccttttagtatacatatgtgagttttaaacagagaaggagattaattaccaaaataaggccccatttgagggtttttttaaaaatcactggtatgcatatgaaatcacagtataagtaaatattgaaattacacacctgaaattccaaataaactgacaagatatgagaaccttaaacggagtaccgtgatttcaagtatgtcttcagagaaatagattaatattatctcatctttttaattagaaatctggccaggcatggtggctcacgcctataatcccagcactttgggaggccaaggtaggtgatcacctgaggtcaggagttcaagaccaccctagacaacatggtgaaactccggacgttgtggcacacacgtgtaatcccaactactcagaaggctgaggcaggagcgcttgaacccaggaggcggaggttgcagtgagccaagatcacgccactgcactccagcctgggcaatgagaacaaaactccatctaaataataataatagcagtagaaatctgaagatttttatgtccactaagtctaaaactgtactttttagactttgaaaatagttaattatattaaaactatttcctggaatgtttttgtttttttcacaagtgcagagacattaaagctaagcaaaaatcaagaattatttgtctttattatcagtccttaagctttagaaatataatttcttgctatggtttttctggatattagcatggggcagctagcataaacaccaaactgatacatttcaggaagtggaaataatattttcaactagccatttatatatttcataataccctcaaggtttcttagaatttattcttcatagaaatcaaagcactcttcactaatgaggagaaaatgttgttttgaatgttaaaaaaaatgatgtttaagagaatttacatatttatttataggtgtcatctatttttaaatttcttttaattaaattttattttattttaagttctgggatacatgtgcaggatgtgcaggtttgttacataggtaaacatgtgccatggtggtttgctgatgccatctatttttaaacctggaaaattctatttgcctaaattagaaaaccttattctaaaatagtggtagtagtaaaagtcctcagggttttccccacttagcttcagtgatccaaaacaccttttttttcttaattagctgattcaactatgctagctataccgaggtcgactaccaatttaaaacacaagttaaaaacgtaaactgagtattattctaagtgaactaactcaggaatggaaaccaaatattgtatgttcttgcttataagtgggagctaagctatgaggatttaaaggcataagaatgatataatggactttggggactgggggtgggggccagggaggaattaaagactacacattgggtactgctcgggtgacaggtacaccaaaatctcagaaattactgctaaaggacttatccatgtaacaaaaaatcacctcttcctccaaaactattttttttaaaaaacctgtaatctgttaacctcccatccattctgagaaagcattagtgagctttttgaagtctagataagacccggcagttgacagagtaaatgaaaatacatttgagtgcagaactgaaaaaaaatcattgaatttacacttaagaccaacgtatttgacaaagataattgggcacctttagaactctttgttttctatcattaagtgccctttgataatgaagccaagagggaaggagcattagagtatattttaaatccctgatacatatccattgccaaaaatgttttgttttctctaattcctaaccagtttctcttgaagtacattataaaacatttttaaatcaagatggaataaaatactactcatcagttgacacattggaagcagatgttctactgtgtagcgtttttaaggaaaaaaaatactttgccctattggatcattgcctaagcagggaagggcttaggggcccttgcccctcaaaggtgactgcacagcacccacaagggaccatttccagatccttttcttcactgtgtcaggcactgaattgacaggaaaagggaaaggaggtatgcagtactccctgcccccaccctcaccctaccctcaaacttctttcaggcagcctgagctcttgcttgttctaccaaagagacttaaggatcactattctcttccctttattgaaggcacctcaaagtgataatactgagtgtcagctattctccttcctcccaaaaaatataaaataaaaaatgtcagaatttgcttatttttattttgtttgagaacctcaaattttctagatcacattctcccttttttcttttcctaagagagggtacaactgttttccccagggaagacaagagtcaagtctctgcattctttcaccaccaaatagcatcctaggttcagcaaagcttcaggcctgcaaggattcacccatcaacccagaaaaaggaatttcctttcccatagaatctggtttttttcattccttacagggtaatgttgctctctttcccaagacgtggtatccaggatctgatagcttgagtttcatgaagctttttattccctcattctttcctagtcatagcttttccccttcttatcctcccctcaggactcttagctcttatccttcttctgactggccatcctttttaatcaagggttgcactgctatcccatcttccacaccccttcccactttttttcacgggataacttggattcagggttatggtctctatctgaacagtttccatcttgctttccctagaacagcagtcaggaatacagaagttacagctataaacagcaaggtcaagagtcctggtcaaataccagagaaactgatagcagactctccaggaccaccttctacagggctgcataggtctacatgagatccctcaaacagatgcatccttctgttgggatatgtacattggccaattctagactcagcaacttgtttcatctgaaaatctttctagaactaagaggaatcaggattttctccaagcattttaaagattctaacaaagggtcgtgatgtaattggatattgatgggtgttgataactttagcaaaaagggggaggaatatagtcatctctgggtagagatccattatcaggcagatgcattaagataacacacttagcaagaatattggactctgaagctgaaaattcacaatagtagtctttgcactagataacccagacacgactttcaaaagtgggtgtttatgtctttgttcctgagataaaacataattttccctacttctacttaagatacaccggaagactctagcaagatgcttttagcctcatctcatctggcataggagtgtgcctttcttcatcctcccttaaatcccagcattctagaaaagccctacatttggaaatgacttaaagtaataatctcttttgaacagatgggaattttttttctcccagtcatggacctagctgcctgaggccttcagggattcactatcttcttcaataaaggctatgttctttgtctcttcactcaagtcttgggccctcttctttacggcctggctcttgacctgatagtgctgatcaagtgggatggtttcttctacatttcaaaaagttctcctaatgcgctactgcacaaagagtatcccacagaccagctgctagtctgagaactatttatcacatgtttacaacaagataaggagtattgtcctgaatgtaaattaaccatgtcactaaacactctgtttgttcaactgacttgttccttttaatagaaagactttgttgaagaaggaaatgaggaattgatttacattctggtgaaagttccttatctttttatggtccagtactttgaatagaactctctagaggtcttgtaacagaccattttaggcatgcttatcttcagaaatgaagcaggctatgttttatcttcagcgccttttatttattattattattttttgagatggcgtctcgctgtgtcacccaggctggagtgcagtggtgatctcggctcactgcaagctccacctcccgggttcacgccattctcctgcctcagcctcccgagtagctgggactacaggcacccgccaccacgcccagctaattttttgtatttttttttttagtagagatggggtttcaccctgttagccaggatggtctcaatctcctgacctcgtgatctgcctgcctcggcctcccaaagtgctgggattacaggcgtgagccaccgcgcctggcccaatgccttttattatctactttatttgaacaaaaatggtcctacagcttggtgggtcaaagtaaatatcactttcattcctggggctccttcttccttaattaaaactcactgactactcccatgtatttctcccttcttgaaaaagtatttcaaagccaggcgtagtggctcacgcctataatctcagcactttggtaatctgagatgggtaggatcacttgagctcaggagtttgagaccatcctgggtaacatggcaagacctggtctctacaaaatatataaaaatttgccagccgtggtggcttgcaccagtagtcccagctacttgggaggctgaggcagaaggatggcttgagtccaggaagtcgaggctggaatgagctatgatcacgctactgcactgcagcctaggtgacggggtaacactctgtctccaaaaaaaaaaaaaaaaagtatttcaaaataatcctatcttcccctagcagactttcatctttctctcaaagaagtgtggttcctacttctgtgtgtggttcctacccatgttctgttaagcagcttacccagaagatacatgtctagtgattaggtttcatttagacaagaagagttggaaaaatccaagccctgatatataacctcttttccaccagaattctgagaaatctcttcaacatgaggtctgattttttttttaaaccttccttcttccttccccaacctctaacaggaagattaccagatacttaattgtaagtaaaggtcattatttgtaagtatcactgttaggttgtagaacagtagattgcaacagccatttttttgtgtctgtgtgactagctcctatcagaaggaaactttttcattgaaacgttttcaatggttatgttataaagaggcagaattttccttgaactctaaaattacagcccacttagataaaggtaaaggcagacacagtaggaatgtttacacatgttcccctgtctagaatctataggggaaccatgtggcctttacacctcgactgttgcttgacagtaacaatttggtccagaagcctacagcaggtgttctcagcttgagttcacttcctacttcccaggagtccagctggcagccattattttattctaccttgagaaggctagtttatttattggtaggcttatttgctagtaataattcattgagtacttatttactaggctccattctaaacactttacatttcatttaattctcatagcatagttatttattatccctgttttacagatgataaaactttttatagtcccagggagataaacattagcacaaaatcacacagttagtgatagagctgagtctatgtaactccaaaagtggtggttcttccagtgccccatcctgttttctctaggatgcttcatccctgccatctgttttatttcctgactctcttaaaagtcctaggccagaccttctccaacatctcacttcctctcccaaatctcagtgaaattaggcactagacatggttaccaaagatcacttagtggttacctgaaaagtgcctgccctcttgtttagatgatagaacacaaatgtatacaggatcaaagtttaaataaaaatgtttagattgcactaggtaaacatctatcctagccattgaagatgatacatagtcaaagaataaaagttattcataactaacttaagctcactttgtagggggagaaactaataaaatatgtagcaaatggaaacaaatttaaaaatttttgtaagtgaaaattgtacttaagactttgattcttacaaaaataatgtgtttattttaaatagcccatctctgtaaggctcactgttatttactaaatgctttctcataaattcactccactgttttttttattcacacagaattatttcctaacggatgttcagcgttcaagaaaattactcccaatatagatgaagaaggagcaatgaaagaagatgctgggatgatggatgtccattatagtgaagtaaggattccagggcctgcattgccagttatataaatttcacttcttaaaattcatatatattaaacaattattacagctaacctaattttgaaggtaactaagggttaatgaactttaagtattaaaactgtccagggcaaagatgttcctgtttagagggccctgtctcttgaactggtcccattgtctagttttagaaatacagcatttgccgtcctcaagtcaccattccaataactagataagagtcaacacatgttggaaatttttccataaaaaatagagttaacattgctctttacttcaactaagacagactatgcacaaaagtatttttaaatggaaaatttctgctctaaacaccacatggatagaaaacagctttggctgtcagtcaaccaccaaagatttattgaacattgacttaacagcaaggccttggacttggtgacctaggagctttaaataattaaatatgattagtccctgacctccaaggtccacctgaagagataatacatgtacatgaaatggaaaaaagacttttgaataatatttgaataatgcagacaatatgtgccatgcaaagtcaaaggtgaaagatgccttagagctcaggtaaaataaaggaagtatgatcagagagggattggaagaatgaggacaccctgaaggcatcctaagagacaggagaagggcagggaccacgactaagaggtaggaaagtgtaagacatgtttgaggcacagtgagtggaagtggatccttttggctatagcagtaggttcccatagagaagagtattagttgaggccagattttgagaaactttcaatgtttgggctttattcagtagaatattaaattggcatcaaagtcttttttttttttttttttttttatggagtctcgctatgtcgccaggctggagtgcagtggcgcaatcttggttcactgcaacctctgcctcccgggttcaagtgattctcctgcctcagcctaccgagtaccagggactacaggcgtgcaccactatgcccagctaatttttgtatttttagtagagacagggtttcaccatgttggccaggatggtctcgatctcttgacctcatgatccacctgccttgacctcccaaagggctgggattacaggcatgagccaccgcacctggcctcaaagatttttgagcaggatgatgactacatgaaagcaaggaagagggaaggctaatttggtgatgatgtgggagatgtattgaagatacagggataggagctagaggcaggggctagagagaaggctgccctaattatccagatacgagtagttaaggcttaaaccagggtagtgaaagattcaggaaatagtgtgaggaaaagatgctgatttgctggctgtgggaggggaagggtcaaaggtagctctaagatttcaggtttggaggttaagggaaaatgatagatggatggttttgcaggaaaagtgatgaatttcattttataggtgagttgattttgatgtgaaagcttatcaaaatggaaataaccatcaagccattagaaatgtggaactgaggctgggcgcagtgtctcacgactgtaatcccagtactttgggaggctgaggcaggtggatcacctgaggtcaggagttcgagaccagcctggccaacatggctctactaaaaatacaaaaattagccagacgtggtggcacctgcctataatcccagctgctcaggaggctgaggcaggagaaccacttgaatttgggaggtggaggttgcagtgacccaagattgtgctactgtactccagcctgggtgacaaagtgagactgtgtctcaaaaaagaaaaaaaaaagaaatatgaaactgaatctaaggagagagattagggttagaaatacacatctggaagtcatatccttatgaggaccaaagcagactgaatgttagacataataacggcaagtgaagaccggagaatcaaggactgaaccatgggggaaaagttcacaaagagtgtgaacgtagaaaacaagaaagaaacacagaaaagagattgaagttacagtcccataaaattacatttcttaaaaaaattgtattaaacaatgagatgaaaattacagtgacacacttcataaacactttatgaattgattttttaaaatacacaaatctcaacttagctctggcttatttagttaaattaatgatacacctagaagctttacctactatttctacatagtctgtctccctatcagtaaaataaggacaataatactatcgtggtcacttcacaatacatgcgaaaacttaaaaagtcatgaagtgtgagaataatgtcaggttttatcattgacctacttggcagtgagatttcttaaaagcaagttggtgtccttttaccctcagaacctacaaggatagatacttaaaatatgtttgttgaattgattgatcataacagagatgcaagatacttgaatttttattccagcttaatttttgactgtatagccttggacaagttaattcatgtttctggatattagttagatgatttcccagagacctgcaggttttacaggctgacagcaggaagattcagaggatttcatggggcttaactggttcagtacaactgaacttatatccttgccttctaaacagcagcttcagtgtattcatagaaatggctttgagcttgacccttttttatactcttaaggagagcaataacttttcttaataatcaaaaactgtaattagttttctgtataaacacatttgttggaaatcttttgggttctacaagtaatttatacatacttctatttgatatatacaggtagaatcatgttttaccaagtgccactttatttttcagtttgcataataaggcttcttccttaaaccctagccaattaaaaaaactgacactgatttagaagttacattgaaatgaaaaatacaaacagttgtccatttagtgcttgtatttaaatatgtgagttaaaccggtaataacgcaatgtaacttgtttccaaaaatgtatttctgacttgatttgcaacagttttttttttctgcatgacaccacctcaggaggtcctgatgacgtgtgcccctgcaatcgattttaaacatataattaatatataattgggctgggcgtggtggctcacacctgtaattccagcagtttgggaggccaaggcaggcagatcacttgaggccaggagttcaagaccagcctgtccccatggtgaaaccccgtctccactaaaaatataaaaattagccgagcgtggtggcacaggcctgtaatcccagctattcaggaggctgaggcacaagaatctcttgaaccccaggggcagaggttgcagtgagccaagatcgtgccactgcactgcagcctgggcaacagaacgagactgtgtctcaaaaataaaaataaaaatgatataattaatatgtaataaaatcttaaacaatttgatgaattttgacagttgtatacacccatgtaacctaccatcagaaacaaaaaatagaacatgcccattccttcgggaaaggttcccttgtgcccatttccagtcaggctccccacctccaccatctgatttctatcaccatgaattagtttttatggcataaaaatggaatcaatcattcaatatgtacctttttttaatctggcttctcttgtttaacctaatgtttttgagattcatccatattgttgggtatatcaaaagtttgttctttgtctttatatacaaattttaaatccattcagttgatggattttgaattgtttccagtttcaggctgttacgaataagtctactttaaacattcctatctatgacttattgttgacatatgctttttttctcttgggtaaatacctaggagtagcattgctgaatcctagggaagatatatgtttaacttttaagaaatttccgaagagtttctcaaagtggttggaccgttttatactgtttgccagtagtagatgagagttctagttgccccacatcctccctagcatctgatattgctgatctttttaaattttagccattctattaatattaggtgtgaatcaacatctcattgtggcttttatttgtatttccctaataaccgatgatgtctaccactttttcaggtgttccttggcctcttttgtattttcttttgtgaaatgtttgtcttttatccgttttagaaatcacattgcttactttttattgttgttttgtgggagttctttcctggatataaatcctttgtcaagatatatgtgctgtatatttctttaccagcttctgacttgaccattcactttcttaattgagtctgtggttgagcagaaaattttggttttggttgtaattgatgaaatccagtttattattttataataatttgttctttttgtatctggtcccaaaaatctgtgcctacctcaagatcctgatagtgttgtcctgtgttttctcctagaaacttgtttccgagttttgtttaggtctataatatatttaaagttcatttgtggaatgaaatagaggtcaaagctctttttttaagacagttttttttttttttaagacgtaccatttggggaaaaacaagactttccttttgtcacgttgaatttactttggcaccttggtcaaaagttcggtttttcatatttgtgtgggctatttctggattctcggttctcttccactgatctatttgcccatcttgatgccaatatcacacttgattactataacttaagtcttgaaatcaagtagtgttagccctccagctttattctttttcaaagttgttttggctattctacgtcctttgaatttccatataatctttagaatcatcttttctacttcctcaaaatagcctgagaatggagagtttaacaatattgaatttctcaatcaatggacatttatctgggttatctttaactgccaataatattttgtagttgttagggtagaagtcttgggttagatttactggtagatatgtgatgttttgatgctattgtaaataatattgtttgcttttatatttttattttttattatgttgttgctagtatatagaaatataattgattttgtatgttgatcttacgtcctgcaaccttactaaatctgcttattagttttcatagtttgtatgtcttttatgattttctacatatacaattatgccatatgcacggaacaattttactttttctaatcctgtatgctttttctctttctcttgccttattgtactggctagaaccttcagcataatgttggatagaagtggtgagagcagacattctaacttgttctcaatcttaggagaaacatgtctagcctttaaggtttttagtaaatgccccttatcagattgaggaagatctcttctattctttgtttcttgagttctttttaaatatcatgaatgggtgttgagtgttgtaaatgcttttttcttgcatctattgaaagagatataatttttcttttttattcagtttatgaggttgtatattacattgttttttttttctaattgtaacctaactttacattcctgggataattcatactaagtgtgcaccttatttttaattcccccaatgtttgtcccaaaattgctggaaattttaatttggctagcagatgttaatatacagatgttttattcaagtagcaacatttatttcacatatactatccagtgacactaaaataattactggaaaagccaatgtaagtaaaatattgtccctactctcaaagaatcacagcctattggaaaagtcagatatgtagataatacgtaaataatgtacaaatatagtgataaatctttgccaaaaaagtagtgaaatagaaaaaaagatgtgtagtgtcttgcctaccctatattgataaggagaaggatcctggaaaaggtgatacctaaagtgttttaaagagattaaccaagtagaagggattaaagggaggaggggcacagcctgaacaaagacataaagctaagacacaccattgtgcttcagggaaactgctagtagttcgctgttgttataacataaagtacaaagtttggtatgatgaatgatgagattatggaagtatcagccacatcattgcaagctttatgtgccacatgaaggagcgtgtccgttgttctgtgagtgatgcggagccattgccagattttaagaaagggagagtggcacgctcaggtttgcattttaatcagaaccctatggcagatgtgtggaagatgtatttgaaagggctaagactggaggcaggaagataaattaagaaaaaacaatagtgaaattttgcaccttagcaatgagagaaatggagagaaagggtcagatttgagaaatatttaggaaataaaactggcaggacttggtgatgaactcattagagaatgagtaaagaaagagggtgtaatagttgcgtagatatctgagcctatttgggcttctataacaaaataccagagactgggtaggttataaacaacagaaatgtatttttcactatactggaagctgagtaggtgaagataaaggtgttagccgacttggtgtctggtgaggatcgacttcctagttcatagatggtatcttctcactgtgcccttacgtgatggaagggggtgagctaactctctttttattagggtactaatcccattcatgagggctctgccctcatgacttagtcatctcccaaagtctccacctcctaataccatccccttgggggttaggattttaacatacgcattctgagtacacagaaacattcaggctgtagcactaagactgcaatatcaaagtaccacaaattgggtggcttagaacaagagaaatttattgtctcacagttctagagtctagaaatatgcagtcaaattgttttcagggccatgctccctctaagactctgggtagaagccttctttgtcttctggtggtaagagttgttccttgacttcccctgacttgtggctgcatcactccagtctctgcctctgtagtctcatggtgttttccctgtgtgtctctgtcttcatataaagataccagtcatattggattggggcccaccctactccagtattgcttcatcataaatgatcatatctgcaatgactttattttcaaataaggtcacattctgaggtacttggggttacaacttcaacttatctttttaggagacacaattcaacccataacagacaataaagtcaaaactgtgcttagtttactacctaagggtctataggatattgccactggtgagataggaaacacaggtataagagctagaagatgaattcgattttctaaaggacatacaggaagagctgttttaggaatcagttctacaggtttgaagtgcatctctttaagatagaaacaagctgttatgacttacgggtagcatcagtaattggcttcatgttttcatcgttgagaacatgagatgaaggttcacaaaagagttttatagcaactgttattctggcagcgctggtgatctctattttgagctgttatcctatcattctcagtaattttagaaccatcagtcgggaagtgttctttatcaaaactgagtcattttaataccaacccacaaaaataaaaactaaaaaaatttaaaaaaacatcgaatcattgtaataaacacctaaaccaccaacacaatagcttgaaaaagttgtcaaattttcttaagactaatatgggtaaatattgttttaatataaaaaataatagatgttagacattcagacatcctcaatttggaacaaacaatatattccctttttaaaaatattctttctcgatgtgttaacgtttacaactatagttaacatcttcattatgtgaataaacaaaataatcatagtttactattgttaacatcaattttatatttttaagaatgtttttaactttaaatattttaaatatttgatttagaaaatatcgtcacacaagtatgttccttttgtgcatctcattgaatttagtaccatctgtttgttttctaccaacttgaaatgcttcaaaatttatttgtccaaaactctaaaactatttttaattcctaattggatttttctcttaatgcaggaggtcttgctggagttgctagaacaatgtgtggatggcttatggaaggcagaacgttatgaaataatttctgagatttccaagttgatcgttccaatttatgagaaacgtcgtgagtttgaggtaggcaatttgaacatttttatcattgacttatgtattttattttggttttagggaaaacagtaatatagttctgtcactattattcgacttgtgtcctctgaagaatataaggttcattacattatgacttttgcattttatcatagagtatagtctatcattttgacacatttgtccaatttcaaagtgacaattcctaaaaatgctattaaatcctgagattttttaatgatttcaccacaaaggaatgataaatgtttgagatgatacatttactaattaccctgttttgatcattacacaatgttggcatgtatggaaacaacatttcccccataaattgtaccccataaatatgtacagttattatgtgtcaattaaagacaacataaaacttcctctggtcctgcttatgaaaataaagtaaaacttaaaacatcctaccttatattcatttatgttttccaaatgaaattaagggtaaaagatccaaaatagaaattgagatttaaattagaccagtggttctgaaaaaaaaaatttttttttgagatggagtctcgctctgttgcccaggctggagtgcagtggcgcaatcttggctcactgcaacctctgtctcccgagttcaagcagttctcctgcctcagccttcccagtagctgggattacaggcatgcaccaccacgccccgctatctttgtattattagtagagacggggtttcaccatgttgaccaggcttgtctcgaactcttgacctcaagtgatcctccggccttagcttctcaaagtgttgggattataggcgtgagccactgtgaccggcctgaaaatatttttatctagcaacctcccctcttcctctcagagcgtaaaataatcagtgttgttttcactaaaccttcacttcaaaaagctgtcaaatttccatgttacccagggaagaggcatagacatgattctattctttataatttagcggagaacctaaaggtgctggcaaatgacagtggggtaggtaataatacactagtaatacccctattatgagaattttaaaattttgacttgccagataaactattgataaagtttagttaataaagaatagtagtataatgcacagcaattgccaccagcactaaacaggattttttaaatattcaagtctcttagtccatatcataatttctgttgctactatgctgggaagggatgatttaggattcaagccattttaaaaaagcaaggcaatttattctttttttttgttttttattttatttatttagtttttttgagacggagtcttgctctttggcccaggccggactgcagtggcgctatctcggctcactgcaagctccacctcccgggttcacgccattctcctgcttcagcctcctgagtagctgggattacaggcgcccgccaccgcgcccgactaatatttttttgtatttttagtagaggcagggtttcaccgtgttagccaagatggtctcgatctcctgaccttgtgatgcgcccgccttggcctcccaaagtgctgggattacaggcgtgagccaccgtgcccggcctggccatgtattcttaaataaagcagttaggcctttccttgttgacgtggtttctgagagtgaacacacatagatttaatataatctgagtagtgttttcatctctcctccaaactagctctgatcaaattcactttttcttcccagattctaggtcttcctctctctgccatacttttggtgtatatggggcatgcctgaaaactcatagtagaattcaagtgaatatattaataagctgaagtataggtcatacagatggcaaagaatagcctatgagacaaaaccagatttgccattacccctcctatcaaagcattacatctgaagaacctttgtagtaatttcaaaataaagtccccattttttgactcttaggatgaaggaagttctggctgttagaaacccagggagccttttgctacttagccaaccaacagggaagaaagaaaaatatatcttctttatacattaaaggaaatgatgttttctacaggggaactactcctatttccttggaggggtgtaagggtctgtataaatcccctagaactctgtatagatgaagtaattgtgtttaagactgatgtagctggagcatggtatacacgcctgtgattccggccacttgggagactgaggtaggaggattgcttaagtccaggagattgaggcttcagtgagctatgattgagacactgcactccagccttggctacagaacaagatccaatctcaaaacaaaaccaaaaagtagaacactgatgcatactttttcagtgtatctctatggaacgggctgaaaactatcagagatagcagccaaagtaaggaagatttccctccaattgagctcaattataaaagataatatgggaggaattttagagaaagaagcttgtgtgtttttccttttttgttgaggtgaaatttatataacatacaattaaccattttaaagtatagaaatcctattatcctatcattctcaatatgcacccaccacctctttctagttttaaaactttttcatctccccagaaaaacactccatacccattaagtaattactccccaccccactcccattttccaataaccactaacctgctttctggatttgcttattctggatatgtcatataaaaggaatacagattgagcctctctaatctgaaaattcgaaatcataaatgctcccaaatctgaaactgtttgagcatggtcatggtgctcagtggaaatgctcattggaacattttggatatcagattttcagattagacatgttcaattggtaagtccaatgcaaatatttcaaaatctcaaacacttctggtccaaagcatttcagataagggatactcagcctgtgatattatatgtgaccttttatgtctggcttctttcagttagcataatttttttttaattgagacagaatctcactctgtcatcgaggttggagtacaatggcatgatctcagctcaccgcaacctccgcctcctgggttcaagcaatcctcacacctcagcctcccaagtagctgggaggtgcacaccaccactcccggctaatttttgtatttttaatagagatggggtttcaccatgttgtccaggctggtctcaaactcctgacctcaagtgatccacctgtctcagccttccaaagtgctgggattacaggcgtgagccaccgcacctggcctgttaacataatatttagaggttcatgtatcagttgtagcatatatcagaacttcattcttttttatggctgagtaagattccattgtatggatatactgcagattgtttatccattcatccattgatggacatttgggttgtttcaccttttgtctattatgaatagtgctgttgtaaacattcatgtgcaagtttctgtgtggatatatattttcaattctcttgaatatatactagggagtagaattgctggatcatttggtaattctatgtttaactttttgaggacccacgaagctgttttccacagtggctgtaccgttttacatttcgatcatcagtgttctaggattcctattacttcatatccttaccaacattttttattttctgtttgttttattttgttttataaaatccatcctagtgcatgtgaagtggcacctcattgtcttggtttgcatttccttaatgacagtgagattgagtgtcttttcgtgtccttcttggctgcttgtacatctttggagcaatgtctattcaggtcatttgcccatttttaaaattggtttgcatatattttgttgttgagtggtaagaagtccttaaatattctgggtactaaacccttatcagatctgtgatttgcatatattttcttccattctgtagctcgtctttcacatttttgataatgttctttgcacaacgtgctctctttttctggaagtgcggaaaaacatatcctttggaaatatctgtgaacttgcataaaagcagtcctcactgcagcttacaccattgcttatttttatatttgcattttattttcctttttaaatacatggattgtttattctcatagctctctacctgagggctcaagcaaagcatttggctgccctttcagttaaaaatattccgatcctgtagaaaatagtagttgataatacagtatttcaaaatttaaaatttccattgagatgtgaatgaaatgaagcatgatattaagaaatacattgtcattgaggaacagaaaaccacataccgcgtgttctcactcaagtgggagctgaacaatgagaacccatggacacagagaggggaacaactcacacagggcttgttgtggggtggggggtgaggggagggaacttagaggatgggccaataggtgcagcaaaccacgatgacacacatctatctatgtaacaaacctgcatattctgcacatgtatccccccttttttttttagaagaaatttcttttaaaaagaaatacagtgttattttaccattttaagttctacccttagacctaaagttgttgaggactttgattgttacaaagggagatgagtatgaatggccccaccaagaccattttgaaaagaatatactggtgctttttatttttgtacattcatcttgaagacatttagtaattaaacaaaaaacaaagctgatttgtatatttttatttttcagaaacttactcaagtttatagaactcttcatggagcttacacaaaaattctggaagttatgcatacaaaaaagagacttttaggcactttcttcagagttgccttttatggccaagtaagtgtacttgaatccataaagttttcctttttaaacattcacctttgaattactagtttactatagcagctaggagtctatccagatagagtgcctattacaacagcagggagcctcttttgtatgtataaagttcactttggttctcatatctaaacccttcaggtcagaatacaacagaaaaggttttgatttctgtcagtttcattttctgttaagctttttaaagtacatattaaatatatagtagttaaaacttttaaataaaaaacaggtaagtgtacagggaaggaaaaaacctagtttggaaatcttcctcaggccatatgtttatgtgattataaatttgaaaattaccaggaatttaaaaattctcatgtatttgaaattaaaagggtaaatacaagcatgggacttttagtaatattattcaaaatttatttcaaatatattattactagttatttagtagattttctttaaatgttgtgtttgctcatattatttataagttattatttgtttaactttataatagtctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaacacataccctacatgttgaaatcattatttgttagttccaggcattgtacattgctcctgactttttccttttttaactggtagagaagcatgaaaacagagctttccagataataaaagaaagaacaggggctttggagtcagagataccaagcttcaaatctctactctctgccactcactagctgtgtgaccatggggaaggtacttaactctctgtgcttcatcgttcttagtaataaaatggagataataatagtagtattttcctcatgaggttgttgtatggattaaatgagttaatatatggaaagtataatcactttcctggtacataaaaagcattcactaataatagcaagctagcatgctcactaaaggttagatattattgtaaatgctattgtacatcatgattctccgttacatcatgattaaaatcaccttggggcacacattttattctaagatatccttagttcagtaatagtgactgtagttaacatttgcaatgaaataggtttaggagagatccttgagccttgctctaaaggttatccatcccactaggccctgccaaggcatagtgagaaggcttatattatagcaagagaggccctttcctaggaaatgcatagttccctatagacaggatttgggggaagcactgtaggaatgcctgactgtccttagttgccttgggtgtgcccagacttagagctgatttttaagggtaggaagctcatataaagttcaagatttgtatccacagtgatatttactgagtgactatgatatgcgcagtgctatgcagaacacttaaaagctagcaggaagcattaccagagtgaaaaagcccatggctattgtaaagacacttcattgtctaccacgaaaataatctcttcactttgtatacttacatatatctcttggagatgactttatcttaaacacatgcctaagacatttaaaaatagatttggtggtagtttcaacgtaatatatggcaaacactctctacttctttccttatcagtttcactattttgtgttgtttcgttgaattgagacaacagaagattttctccccttgcagccagatagtgtaagacttgttcccacaatattgattactgtataaatggaaaggtaatgaaaagtcagactttctgtgcaacatgcagttttctaccttattctgcctctgaaaactgggccaaagaatgctagcgacaaaccactacaggtggctggactcctgatgtttgttatgtatcatattttagtagttccccacaggcaacagacataataagcagttctggcttttaaaatatatttattgttttctcagtttgtgaaaataaaaattaaaaatattcttttcccttgccaaagaacaaaatctgcttaagggcaaaggcaatttgaagaggagtttggcaatatcttccaatattttaaatgtatgtgtccttggacccaacaatttcacatttaacattttatcttgtagatgtacacatataaatgtatatgtttaaagttgttcactgccacaaaatttatatagcaaaaacctggaagcagtctaaatgtccatatggttaaagaaatggcggtattacccatataatggatataaccacctagacattaaaaagcatgagagatttgtaagtgtccatatgaatctatcaagatgtatatttttttcttttctttttattttattttatttttttttagacagagtcttgctctgtcacccaggctggagtgcattggtgccatcttggcttactgcaacctccgcctcctgggtttaagcaattctcccacctcagcctccctaatagctgggattacagtcgctcaccaccacacctggctaatttttgtatttttagtagagctggggttccaccatgttggccaggatggtctcgaactcctaacctcaagtgatccacccacctcagcctcccaaagtgctgggattacaggcctgagccaccacgcctggccgcttttaatttttttcgagacagggtctggctctgtcgcccaggctggagtgctgtggcacgatcacagctcacggcagccttgacctcctgtgctcaagcgatcctcccacctcagcctcttgagtagctgggactacaggtgtgcaccaccacacctggcttatttttgtttcttgtggggtttttgtgtgtgtgtgtgtggagacggggtctcactatgttgcccaggctggtctcaaactcctgggttcaagcaatcctcctgtcttagcctcctgaataggtgggactacaggtgtgttaccaccataccccagctaatttttttatgtttcttagagacagggtcttgctatgttgcccaagctggtctcaatctcctgcgctcaagcaatcctcctgtcttggcctcccaagccctcagattacaggcatgaaccactgcaactggccccatgtaaatcttttaactaagcaatttcttttctaggaatttatcctaaggaaaaaatcagaaaaaaaatgcacacagttttaaatacaaggatgttcatcagaacattatttacaacagcaaaaagttggaaaacagcctgtctccactaatgagagaatggtccaataagtcatgtttatccatacagccattaaaagtaatgtcagtgactatagtataaactattggccagacatggtggctcatgcctataatcccaacactagggggctgaggcaggaggatcacttgtgcccaggagttccaagctagcctcagcaacacagggagacctcatttctacaaaaaaatttaaaaattagccaggtatggtagtgcatgtctatggtcccagctacacgggaagctgaagtgggaggatcacttgagcccaggaggctgaggctgcagtgagacatgatcacaccactgcacttgagcctgggcaacagagcgagactccatctcaaaaataaataaataaactatgatacctgtgtttttattgaggtgtaattcacataatgcacaatcaaaactgtttagtctgacctcaattttctgaatacataggcatagaagaaagatgagaaggaaatatataaaaatgtgaataatgatcattgctgggtagtaggattacagtaatttttttttttttttttttttttttggagacagagtttcactttgtcgcccagactggagttcagtggcgcgatctcggctcactgcaacctccgcctcccaagctcaagtgattctcctgcctcagcctcctgagtagctgggactacaggctcatgccaccccgcctggctaatttttgtgtttttagtagagacaaggtttcaccatgttggccaggctggtctcaaacccctgacctcaagtgatccgcccgcctcggcctcttaaaatgctgggattacaggcatgagccaccgtgcctggccaattacagtaatttttaatttcttcgtatgtttctgtagtctccaaatagatttctgtaacttctttataatcagaagtaagtgatttttaaaaagaagaatgaagacgccctttattggaaacacaattataatggcaatgttcctcacttggtctcaaagaagttagtaggttaccttatctccttttcccttccactgaataaaataaaaaataaaataaaataaataaataaaaactttcttattttataggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattttctttagttaatggttttttgaaataaacttgaaataagcatatatttctcagatatggatttcttgtatattttgggatttttaataaaaaagagaaatgccaaaacttcttttgattattgcattctggaaacactctcatttttcttctattgtgatataggtcaatgctggtccattagcatatgcaagagctttcttaaatgacagccaagctagcaagtatccacctaagaaagtgagtgagttgaaagacatgtttaggtaagtgttttatagttttcaggttagacccgtgttcgttttctctattttcttcttttaaaaaacaacaaagtattgaccaaataatacccttccaaaaagggacattctctgtggtcttttacaatatctaagtgacctcctaatggcactttgagcaaatgtgagatcagtttcatcctgcaggacattaacaataccctagtgacccaagagattaaatatgccagtttactatattgctttgaatattttaagtgacacaaacacaagcctatgttccttatgtgctttccttcttcacccaattgacctcctgttacagcatttcagaccatttggggtaggaatagaagtggggcaggaaagattgcataggctcactccagtcccctgtccttacttctacttggactctgccaaactagggcatgcaacatcttgtcttcagtgagcggctctgtaagcttaggcatgtatgaatgctcctacattagagaaatatctttaatatataaaagtcttcattcagaagaagagaaacagttgagtaatatggactaaggagaaagatgataatctatccactcatttgctcccgacttattttgtttacttttcctgtctatgttttatcagctgttccagagtgcagagtaaccagtagtcattcattcaccagtattaatgcctggtacatgcaaaagactatttgttgctatgacagggatataaaacaaatggacaatgaagtactttgtcccctaagacctacactctaattgtggacattaaacataaacacatgaaataatggaaaaagacttttatgataggtcatcaactttctgttctccttcctagcagcccagggaagatccttcatacctgtaccacccagcactgtactagccacatagtaagctcaaaataaattctttttgaatgaatgactcgttatttataggtgcaaattaatgtcagcacaactttagctgatagaatgccaaggaaatgattgagcaagtaggctttccagagggtatgtgttttgagccaagtcttgaaggagataagaaatgaaaccataaggcaaaggtggaaaggaaagaaggcatttcagacttaggaagagacattaagaaataaatgcacagtgagaaaatagaggattctgatcttcttcctaggcaagccatggctaaactgagttatcaaatggattgtcagtgatacttcctaagaataaataacaagacctttatctttgatattcatccacaggaaatttatacaagcatgcagcattgcacttgaactaaatgagcggctaattaaagaagatcaagttgagtaccatgaagggctaaagtcaaatttcagagacatggtaaaagaattatctgacattatccatgagcaggcaagtattagggtgactaaaactgaaaacatgatctgcgggtcccaaaattgttgcttagcaaaatataatggttcaaaatgcacaaccttaaagttattaagtctatattttaaacttttttcatattatctttaatcatttaagtgatacaatacaaatcaaatttgcaacaattatctaaagtggttagtgatgcagttatctgtaagaaaccattttgttttttgtgctccagtgtcagaggcaagaggttgaactgaggtataccgttatcaaatagattacatagtttgtttttagaaactatctagttgatgagtttctattcctcataatgcatagaaaaagcagcaaaaattcctccttcacaaaagatatgacaattgcacatgctattttaagtgagtatctactatattacagttatttcatttgcatgcagctgcatgacctagtgttgaactctaaattattcaaattgaaaacaaattattcaatgtactgttattactgtaatcaagatattctgagtggtcattttataaaattttgttttccttttgaagcatggatttttcaaatctactgtcgtatttcccacttgtctgtatcagttattcccataaaacatggctatttctcttagatatagagaccaataatttagactcttaatattgtatattgatagctaaccaagaaaactcttagtttctattggcttatatttatgcaagccatcctgtcattatgaaacatatttgggtgtgccttacttttggcaaatgttgactttgtagtgaattgagtttcacataaaagagagccaccttgtagtcatacactttgaggcatatattaatactgagaagtaagacaagtgttaatgtgtactgaaatttgaaatattctcttgagctccataaatgattacttgacaaaaagacatgactggatattccttgtcccctttcagtgtaatctgttacagaataccgaagtatatagtcctttcaaaaacttcttcaagcttttttttcttttttttttcttttttttttttttttttgagagggagtctcactctgtcgcccaggctggagtgcagtggcacaatgtcagctcactgcaacctccgcctcccggattcaagtgatttctcctgcctcagcctcccaagtagctgggactacaggcacgtgccaccacgcctggctaatttttttgtatttttagtagagatggggatttcaccatgttagccaggatggtgtcgatctcctgacctcgtaatccacccgcctcggcctccaaaagtggtgggattacaggcgtgagccaccacgcctggctgcttttgatttttaaaaggatttatattatcataaagctataaattacagatttctcagatagagttgggggtggtcattgtagcatctgttgggtatgttttgtaatttcttagcaataagtaccctccttgcctgtcacatctgaccagcatagataatcagttattcatctcttaacattctagtatgctttcagattagtgtcatgagttaatatttttgtaagaggaaatttctctattataaattttatttaagccttatgatttgtagcaacacaaatgatatgtctcaatactgccactatagatcaatctgtgggcttaatactgaagtttcacaactaacttgagaaccaagtattgaaagcttgggacctaagttaggactttatggtaaagagagtggatataatgtatatagcgttttttacctcaatctactttaagcacaagatttctgttgctttttctttagattacacaaaatggatcatttaaaaaatatttaaactaatacgaatatctatgtttatatacttactggaatacaatctttaaattttatatttatgaagttcttcctttccaagaaaaatcttctgtatcaattagcttatacaattataatgtgtctttagaaatatgcacttaagacttttatcttcatttactattattttcaagtctccagggaaggaacataggtatctgcatgtttcaaaagtcccatagatgattctgagaaccactgtgttagatcattcataaactcatgtcagagtctaccatttagagctcttgttatgaccatctgttaaaaaatattttaaagattgtgttacctctcgctttttattgaattttgcattttacagtctttgtttttcttaatgagtaactagatcttttctgcttttttgatatgctgcctttgtaatacagctttgaagacttaagtcggtaatgttattctttgctctctctgctttctgtctttttaaataactgtcagtgataaattgaaatatgcctgcaatttcatatacacattctttttttggcagtggctattttgcttcatgataatcatgctgatttcttctgttttagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaa

SEQ ID NO: 5855 - DNA, 190238 bp, human
cagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaagcatttccagttcagaggctctcaatgaactgagctgtcaatgaactgagggtcaggaaagttaaccagagtgttagcacctaaacataaaatagtctcgctactggaggttagcagggcccagagcaagccactccaccacgatctgtacaaaagaccggtgcaggttgctgtgaagccagagaggcctccttgctgaacccttgtttaagcaccaaataggaaaatttgttttctgagactaacatgttaaaaaattctctggattgagtctttttctattctaatcaccagtgaacctttgttttttaagctttcattgctttttttttttttttagacggaatctccctctgtcgcccagactggagtgcggtggcgggatctcggctcactgcaagctccgcctcccgggttcacgtcattctcccgcctcagcctcccgagtagctgggactacaggcgcccgccgccacgcccggctaattttttgtatttttagtagagacggggtttcaccgtgttagccaggatggtctcgatctcctgacctcgtgatccgcccgcctcggtctctcaaagtgctgggattacaggcgtgagccaccgcgcccggccttcattgctttattacatgccaaatgcttgtttattgtacaacagctagaaaaacagaaaagtaagaataattatcaccatctcattacccagaggaagctccgtaaatattttaatgtaaatatttacctttctctctttctatgtgtatatatacacatctataaatacacatatatactgtatatatagatgtatacatatctatacatacatatacatacccacacacatatatggatggaaagaaatatacacaaactttttatttttgtttatgtattttttttttgagacaaagtcttgctctttacccaggttggagtgcagtggtgtaatcatggctcactgcagctttgacctttgggactcaagggatcctcccacctcagcctcccaagtagctgggactgcaggcaaacgccaccgtgcccagctaaagttttttttgtttttgttttgttttgtttttttagtagagacagggtttcacagtgtttccccaggctggtctcaaactcctgagctcaagcagtcctcccaccttggcctctcaaagtgctgggattacaggcatgagccacttcgcctggccacacaaacttttaaataatttttttcatttatcagtatcttatgaatattttttgatgtcaataaatacaaatctatataatcatatttaatgactgcctaaattttcattatgggtgtaccagaggtaattatcatttattgtttgatattttgatagtttttctaattttgtgctgttataaacatgaactataaaggtaaatagctatatatctttctttacttttaaatttaaattaattaaaaataatcatatccaggcatggtggctcacacctgtaatcccagcactttgggaggctgaggcaggcatatcacctgaggacaggagtttgagaccagcctggccaacatggcaaaaccccgtctctacttaaaaaaaaatacaaaaattagctgagtgtcatggcgcatgcctgtagtcccaggtactcgggaggctgaggcaggagaatcgcttgaacccaggaggtggaggttgcagtgatctgagatcccaccactgcactccagcctaggcgacacagcgatactccgactcaaaaaaagtaataataataatcagtttctaaatttcacttgccacagttcaagtgctcaatagccacatgtggctagtggctactatattggactgcatatactatatatgcagataaagagcattaccatcagtaactgagtgaatgtctttgagaaggcatcttcaaaattgccaaatcgtccccttaggataaatttctagcagtgaacttgcttgctcaaagattacactgtatgcatttttagtattaaaaattcctcttaaacatactgttaaattgctctacagaaagtagcttcagtttactctttcaccaggagagtgtgagggtgttcatttcccctctcccatgccaacgcttgttagtaatattttaaaaattttttgcagtttgataggaaataaatggtacatcaccgttctaatttgcatttctttgattactcttaaagttgaacagtttttcatgttgattggcctttcatagttcttctgttgaggcttgaatgaatctgcttacagacttatttcctcgtttgtgattcttgcaatacagtctccatcccccaagattctgttttgctaagtctggggtggggcctgcatctgtattctttaaaaggaccccagatgattctcatgtgcacagaaacactcatctagaccgcttgtccactcaaggcaggaatgtcctttccacccagccctgacaaatgattatttagcttctccttaaacacccctgcctgttagagggctatgttagaaaaggttcttgagccgaaatttactgtgtaaatttcaccatgggctagacctagctctgctgttggagccacacgtttgcttccttcctcttttgcataacaacctctcaaatatttagagacagccaccatgtcattttaaaattcactcttcacaaagccaaagaggctacatttctttccttcgttccccacatgacttggtttcaagattcttcatatcattatcatcctgtttgggctcttttccaagttttctatgtcctacttaagatgtgagagacagagcataagctagaggatcagatctggtcttgaacccaacgtctgtcacttgcctgaattgtgaacagacgcaagtaacctggtctcattttccttatctgtgaaatgggaataaatagtagtacctcccttgtggagttcttgggaataacgaaggtaacatatggaaagtttctaatgtataagtgattcataaaggttaaaaaaagagatctggccaaaacaaaacaaacaaacaaacaaacaaacaaaaaaacagtattccagaaggatctgccactgaatacagtcagggagggggcaatgttttgtatcatttctgggtgtgagccgagaagccgggggctgtgtattcatttttattcccagcccagcccctcacacagtgtctggagtgcagtagattcttaggtgttttgtgaaaatacactgccaaccttgggtaggatggactcattgttgggagaagagcctggaggccaggaaatgacttaaaatacagttaatatagttctggagagagataacaaaggcttttttttttttttttgaaatggagtttcactcttgtcgcccaggcacgatcttggctcactgcaacctctgcctcccgggttcaagcgattctcctgcctcgggctcctgagtagctgggattacagatgcgtgccaccacgccccatataatttttgtatttttagtagagatggggtttcaccacgttggccaggctgatctcgaactcctgacctcaggtgatccacccacctctgcctcccaaagtgctgggattacaggcctgagccactgcaccaggcgaacaaaggcttttaactgaggcaatgagaatggagataagggagaagacataagaaacattgtgctgagaaaatcaacaggatttggtgattcttaaaagggaaggagaagggggaggaagaaagagaggaagagcggaggtggagtcaagataattttgaggtttctcagcttgtgtgaactgaaggaaaagcaagtttgttgataggggaagggaaaagaaaatgagcaacttctgtttgagggagttgtcagggcaaagccaggtttcagttaagcaagatggtggctgagcatataaggttgtcttttggcaaaggactagggttctcgagggcagaggtggaaagtgttccaagtgggttcaggaagaagaagagccaggaaaaggccagggctgagtggacagagatgaaattgtaggcgagattagctgattgaagaggtttgcacctttgggggtgattagggaagtgggaggcagggtgtggggaaacgatctggaggccagccccagacttccagttagaatggggtggggatgggaagtgagtccaccccttgggcagatcccactctggggtgggtctgagcagcagttgccctgaggagcagggggtcagtgaggggttgacttcctgctcaggtgctcaggaagaggctaataggatagttcctgcttttaagggagactagaagtacgcaaataacctacagaagatagaagccagataggagtccagtggtcattggtttcccagtcttcaccccatctccgacccccaccccagcccccagtgctctctcttaagatccttaacgtttttcaagactttcgtcctttctgggttcgacaaggttaaataggcctttactaatgaacattgttctgtttatggcatttcccacatttatttgaccacagaccctgccccacccccaaccggctttttatggaaagtggagagtaaatggtaacatctaacaggctgagaaattcctatatagtgtgcgtgtgtaactaactcatcttggcgttctcttacttgacctctgtggattgcaagcagtggttgctactttcccatgctccacgtcaagaaccacccttgctgttcagttcagaggagtaattcacctgtctgattgtgctttctcctgagctatagaattgtcagcaagtcatgttgaaagacgattagtttttaaaaataatttgtttatcatggaaggggaggccaaaactacatgagggtacagctcgagccatttcttctgtaaatcctaagggtacttagaatacgtttctctttgagatttacccctcttggtttaatttttatcaggcatgcagaggagttggtgggtaacattggcctgccgtttatatcagcctacagccagatgcctttttgattccttgcaggaccccaccctggacgctcccagagcagtagcttgaatggagcaaagagacagtctcagttagctgccattgcctttgtaagcttgtgcttcagagcaaagtggttaagagcttgggctctggaagcatgctgcccaggttcagagttcagccctagatgaccttgggccaattatttaaccttcctgggcattggtaaccccctcaggggcttgttgaaaggcttaaatgagttatttgttttgttttgtttttgagacggggtctcgctctgtcacccaggctggagtgcagtgacacgaacttggttcactgtaacctccgcctcctgggttcaagtgatccttccatctcagcctccctagtagctgggactacaggtgtgcaccaccattgcccggctaagttttgtgtttttagtatagagacagggttttgccatgttggccaggctggtctcgaactcctgacctcaaatgatccgcctgcctcggcctcccaaagtgctgggattacaggcgtgagacaccatgcccagccttgagtgagttattatattcttaatgtataatattgaaagcacttcaagtggggtttgccaattgttaagtactgatgactgttggctcgcattatcatccccaggctttatggtgggcaagagacgtcttttgtatatgtgttacaagtcagcagacagaaaagttaactggaagaggggaagcaggtacccttgctttaattccttgctccagatgatgccccaaaggggtgagccacatggctgatccaagaatcttacccttcctggaagaacaagctggcagacccctctgcatgaggttcttgccaatacccgttcccagtctgacttagtcatactgaaaagcctagtggatggtagcaagggttctgggtttttggcattttctaccttcacacgagtttaatgagtgagtgggaaggctggtcctcaagtggggagaagcactctgtcctgtgccttgggccggaaggctctccagactggggaaactgtacctgtggcctttggcagaagcacttacctttatgccagcctgttcagtgtgatttatgcaaaggggtgaatagaagagaattgggatctgtgtggaaaaacagagcttggacatgcctacctttccctttcaaaccttcactgatgccaggcacgttagcctatgcctataatcccagccctttgggaggctgagctgggaggattgcttgagcctgggagttccaggccagcctgggagatacagggagacccccatctttacaaaattaaaacaaaaatgagccaggcgtggtggcacatgcgtgtagtccagctacttgagagactgaagtgggaggattccttgagcccaggagttcgaggctgcagtgagccttgattgtgccactgcactccagcttgggtgacagactgagaccctgtctcaaaaaaaaaaaaaacaacaaaaaaccaaaaccaaaaaacctttattgttatccctttcactcttaatcctcacatttaatagtcaaataaatattgaaatgcaaatgcttttttaaagttctattttggggctgagcgcggtggctcacacctatattcccagcactttgagaggccgaggtgggtggatcacttgaggtcaggagtttgagatcagcctggccaacatggtaaaaccctgtctctaccaaaaatacaaaaattagctgggcatggtggtgcacgcctgtaatcccagctacttgggaggctgaggcatgagaatcacttgaacccgggaggcagaggttgcagtgagctgagatcacgccactgcaccccagcctgggcgacaaagtgagactgtctcaaaaaaaaaattatattttggaaacatacgttttaataggaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaggccaggagttcaagaccagcctgggcaacatagcgagacccccgtctttccaaaaaaataaaaagaatagtgcacacaggttcctagcagagtcagtacagtggaaaacatgccgagtgttccagctctacgtggttcatcttttgtctgtgtgcagccttgcacaatcatgcctaaatttgctattaatgatttcctgcgattcttctccacttttattgcctattgagtttattgttcatgggaagttatgtgcttttgccgtttttgacttctgttggattgtgtatatgtttcaagctgctaagaaatgttagaagatattctgatacttcagcgttcccatcgcattgctttccctaatgactggaaatattttactgggtaagatttaactgagaagtcaagtgttgcttccaagtctctgagacagaacatctttatttgaagtgtttcagtgaagtgtgtcagaaggctggggaattcatttgtataagattttttttttttttccggagacagagtcttgctctgtcacccaggctggagtgcagtggcaacctccgcctcctgtgttcaagcgattctcctgcctcagcctcccaagtagctgggattacaggcatctgccaccacgcctggctaatttttgtgtttttagtagagacggggtttcaccatgttggccatgctggttttgaactcctgacctcaggtgatccatccgcctgggcctcccaaggtgctggaattacaggcatgagccaccgtgcccggcccgttttttaaatggtgacaagaccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggacaaaaaaaaaaaaaagagggatggggttgttattgagaaatgtgggcaagatcagtatagatttttgcttgccaaagtaagcctaaggatattgagaactgtttgcaattggccatccctccttactttgctatttgaataactatatggaaaaaaatatccagaacactggctctgcagaggtacctgggatcattttcatggaactgttttcatgatttttttcaagtgggttagtgctgtccaaaaataacaacatatatatttctttccatgccttttatattagtagtttagttttcccacttgagaaactgccagctttatgccttgcagggcctgttgtcacagtgttcacggtgtgaatggaagagtgctgttggcatggccagtttactttcataggtgaacacgttcctaatgcttcagtacattaaatcgtttcctagagatctgaaggagggaatgctaccttccaaggtacctaccttcccaccaagaaataacttaagttcaagaaggttctaaatcaaccggtacatacatggaactgaatcgttatttcaaagctcacaggggccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagctttatggtctattagtttcctattgccactgtaatgaattgccacaaacttagtgtcttaacacagatgtgttccagttctagagatcagaaggccaaaattggtttcactgagctaaagccaaggtgtccaaaaagcctcacttcctccagaagctgtaggggaggatccattgcctggtctcttccagcttctagaggatgcccacattccttggctcatggccccttcctccctcctcaaaccagcaatgactggtcgagtctttctcacatcctatcagtctcacactgcttctgtcattatatctccttctctgacaccggctctcttgcctccctctttcacttataaggaccttggttccaccttggtaatctaggataattgccccatctccaaatccttaatttaatcatgcctgcaaagtcttctttgccatgtaaagtaacatattcacaggttccacggattaagatgtggccatcattgaggaaccattattctgcctatcacgcaagatgtcacccaagtttgaggactgatggaatcctggggtcagaggggttcccagcacaggtcctgacattacagtggaggaggaacagggatctggcaaacagccaggcgcagaagtcttcatagaattcaaatgaggaagcacaatcccttttgcgaattttggctgaaagaaagcaatacaggtctgcagtctgcaatttcaattgacatgttttcttaaattcttcataactaaatgtctttccccacacaggactccctgagcctggagttcttatagcgggcactgctttcagacttgaggtgttttaggatacaagctgggcagacactttgcgggcatttagccagctcaggcctatagaattttccaccttcagttaaagaaaagagcaaagaggtaggggtgtgtgtgggtgtgtggatgtatgtgtgtggcggggggtcagcggggaggtgtttaaaagagaaagcgatggttgcacatcacataaaataactatttggccacaagtcccaagatacctctcatatgtcctgtgtaagagatgctttgcccagcctgaaggtcaagttagactgggcatggtccttctgcattttcaaggtaatcacagaatcccttcccagaaatggctttctaaaacacatgattggagaagcagaaggaaggactggaaaatctatctgagttctttctggcttcatgatgatttcaattaaaagataaatggaaacttcccctctctaccacatctagtcactgccatcttagagacacatagaacaaaagtttcctggctgataacatttgcatcagccctcctcacactggccagtatgatgtccatgatgtgtctgatggcacagagctttgctgtcctgaagaagcactctatcgtagatgtggattgcatttcctatttttaccttggttctaattggccacggccatatttctcccaggcccagcatatcttttttcaagcctctggctaattgacctggctgtaatgcactgaaaatcattatagaaaaggttggggaaactcccagattgtgtttgaaaatctgtagagacaaaatacacattcactatcttcacttttctcctgttctattttttctttttttcctcctcaataggaaaacagtttcaattctccttataaaccatctcagggtaaatattcagatgttttcagtggaattatgttaaaccattttttgaaagtgcttatctacgatgaatatctactaattattaaatgtgaaagggtattaactgtagtcctatttaaatcttttttagaaaatggtgttcattttctgtaaattgtgggtttattctcttcaacctggcttatttgattttattttgcgatttactactttctgctttggagtttctccttttctctattggctgtcagctgaacttcaccgaggcttctgggtactgtgcattaggtcaatgagcttcatgacagagttgacgcctgggaaccctggaacctctggggctgtgttatgcagcagaaggaactagaaaggaggagggcgttgctggagagtgagctagagagagagaaagttgtgctgagctgtggaagatggctcccctggctgagggagaagacagataccgtcgttcagttcatgctcaaatcccaagggaaatgtttgtgaactgttgcttgaattgaagagaagcagagaatctatttccgcttatttatttatttattttttgagaaggagtctcactctgtcgcccaggctggagtgcagtggcacgatcttggctcactgcaaccaccgactccggggttcaagcaattctcctgcctcagcctcccgagtagctgggactacaggcgcacgccgccatgcgtgtattttagtaaagacagggtttcaccgtgttgcccaggctggtcgcgaactcctgagctcagacaatctgcctgccttggcctcccaaaatgctgggattacagcgtgagccaccatgccctgctccgctgatttctttttaacagatcaaacctacttacgacaaggaggtaggaggaatggtggaaggcaagaccagggcttaatctcaagaaactgaaggattaaaaaggggcaaaaggaaggtattttttttccattacaaagaccaagagaccagagattaaaatattaacaatatttaatgagtgcagccgtatatttttagattcagacaggaagagatcaagtcctttagaaattgtgcttgataaatgaaacagttttgtctggcaccaaaggggtgagtagatacttattcaggggctggagacagtgcatatactgtcaacttgcatgatgcaggacctcaaatcagttagttaaggaattgagaaaatacttgtatgccattcagcatataggatagttggaacatagggaaactcattctccaacttcaatggaggtcagagacacatgaccatcagacacccataggggccagatttctgttgggagcccagggtagagggactcaggtgctaggtctgcctgccctccttttttccatcctatcctctaccagggtagaaggggagccaacagctcatgcctctgccagacccgtgtttctcaaggcagaaaacgctgcttgacaggaatggtggccatagaggctgccactctgagcccttgtgaccttctctgagagcagcccccactgggactggcttcttcttactgactacattctctttcttgcaagctactatcttcccctttccaccttctactattccctaactgctttccccccattctgattttcctcaactgctgctcctggtgtttgcctctgcactgccaccttccaggaaactcttctgtggatctggctgcctgatccagctccttgacttctcccttctaccatgccctgggaaccattgtttgactgtgggcacactccttctctccccttctcatctttttctcacctcttctttctctctcctctgtttggctaaaaagtgtgctttgtggcacagagccatcactgtgtttattttttttaaaccttttctttagccaaggatggaaaattccaaaggcctgagctagtgatggctggatgccttttctggaaatccagtggcctgggtgccaagggaatgttgtggagctacacatctggcaaggttgtcccctaaaatgtcctggctttggatttagttccaactgaaagaaggggaggttctatctggaattatggaatcagaatgaagagttagctaggtgtggtggcacacgcctgtggttccagctactcgggaggctgaagcaggaggatcacttgaacccacttcaaggccatggtgaactatgattacaccattgtactccagcctgggtgacagagcgagaccttgtctcaaattttaaaaaaaagtgaagagtttacgaaattatgtaattgtaaccccagagcccagtttatgtcactgtttttttctgctgggtttaattgggaaagagtggcctttgacttagtagatctttaaaaagtgaaaccttttgcatgagagtcaaataaagttcttgcacctcagtttaatcgatgattttgcttcgttggggttacttggcagaggccaggcacacttcagagcacctggagtgggccttatgggggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaattaccacaaattgggtggcctaaaacaagtttgttctctaacagatctagaggccagacgtctgaaataagtatcactaggcctcactccttcaggagattttaggaaaggatcatttattgcctcttccagctctggtagctaccagcattccttggcttgtggttgcatcactccaatctctgcctctgtggtcacattgccacctctttggtctgtttcaggtctcccgctgcctctttcttatcaagatacttgtgatggcatttagagtccaccccaataatccggatgcgctcttcatctcaagatccttaatttatttcattttgttttgttttttgagatggagtttcgctcttgttgcccaggctggagtgcaatggtgcaatctcggcttaccgcaacctccgcctctcgagttcaagcgattcttctgcctcagcctcccgagtagctgggattacaggcatgcaccaccatgcctggctaattttgtatttttagtagagacggggtttcttcatgttggtcaggttggtctcgaactcctgacctcaggtgatccgcccgccttggcctcccaaagtgctgggattatagatgtgagccactgcacccagccaatttatttcacgtctgtaaagaccctttggccatatatcatttgcaggttccagggatgaggatgggggcatatctttttgtgggggaggcattttttcagtctgtgtgttcttaggttttagagaggattgatatcagtactttcattttagagaggattgatttcattaggcctcctaagatagttgttgatagcttctctattgtattagaatgtaaataccttaaggggctggtaggagactagaaagctattgcttagtagtcagtgccagagggcccagcaattctactgacaatctgtgttaccttgggcagactgtttgacttttgggggatctccttttgcttatttgtaaacattggaagaataacatgaacatcaattggccttgcaaatatgtttataatagcaaaaacaaaaacccaaaaaagttcacctaaatgttcaaaagtaaggatttgggcaaatatatatatatatacattcttacaccagaaaactgtgcagtccttaaaatgacattctttctttcttttttcttttcttttctttttctttttttttttttttttgtgatggagtctgcgtctgttatccagcctggagtgcagtggcatgatctcgactcactgcaagctccgcctcccgggttcacgccattctcctgcctcagcctcctgagtagctgggactacaggcgcccaccaccatgcccggctaattttgttttgtatttttagtagagatggggtttcaccatgttagccaggatggtttcgatctcctgacctcgtaatctgcccgcctcggcctcccaaagtgctgggattacaggcgtgagccactgcacccggcctcctcctctcctctcctcccctcccctcccctcccctcctttttcttctttctttctctctccgcctctctcacactcgctctgttgcccaggctggagtgcagctgtgtgatcttggctcactgcatccttctccccctgagttcaagcaattctcctacctcagcctccctagtagctgggagtgcactaccatgcccaagctaatttttgtatttttagtagagatggggtttcgccatgttggccaggctggtctcgaactcctgacctcaaatgatctgtgcacctcagcctcccaaagtgctgggattacagacgtgagccaccgcacccggctgacatctatatttattgacagtggcaaaaaatttacattatgaaatggcatgcaaagtatgatcctatttttataaaataatgcatatacgatatatgtgaatatacttacctaatcactctgtgcctcgttttcttcatctgtaaaatgtagataatgatagtactgacctcagaggcttgttgcaaggtttgagtaaaattagacattgaagcacgaggaacaatgcctagcacatagagaagcactgaataaacgtagctattagtattattgttatattcaaaacaacattcccaaaggatgttgtatgttgataacatatgtttatatataatgcgtatatgtgtgtataatattaagagtgctagatgggcacactggctcacacctgtaatcctagtgactcaggaggctgaggtgggaggatcatttgagcccaggagttcgaggctgggcaacatagccagacccctgtctcttaaaaaaaataataaaattagctgggcatggtggtgtgtgcctgtagtcctagctacttgtgagtctgaggcaagaggattgcttaaacccaggagtttggggttacagtgagctatgatcgcgccactgcactccagcgtgggtgacagagtgagaccctgttttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttgcgtatctcagattctctgtctgctagatcattaaaattaggatgggctagagattagactttaattcccacttgcatttaattcctatcttcttaagtattattccctgaactttgattataatgtgttttctttaaagtgaaattttgaagaatatatgtatatagtcttacactagatatttgcctgtacatccacatatatctatatatttcatattatctttataattttggggaggcctaagtgcctactctgaattttctgaactgtaaattaaaatagctgctatgttgcgtgtgaaatgtatctcaggttgttgatactggagttctcttttgctgccattaagaagatgaatcactagagggacttaaatttcaagtaaagctaattaatttgcattgaaattgcaaggatttgtggtcatgatttttctgattttgaacatgctgaatctttgttcttttatttaaaataatctttatacttctcatggatttaaaaacaaatggatgggagaattacttatgaattatgagctttgaaatggaaggtcttgcctctgacatttaaaacaattagattatgatgcgcatcttggtaggcaggggctctttccctctctactgtgtgcctcttttttctgtcagcatgcatgtccttgagttcatttctttcttccttctgttcttctgtcttctctctactatatgtctctttttcttacaagatatataaaaatgatttgttacgtttggtggtctctgcctgtagtctcagctactttagggagaccaaggcgagaggattccttgagcccaggagttcaagtccagcctgggcgacatagtgagacccccatctcttaaagaaatggtttgttgtatttaaactgggatttggatatttcctctttgtaactgaaaaagtagggcaaatgaagggatgaataagtgaagcagagaggatttttaaggcagtgaaactactccatatactactgcagtggtggatacatgccattatatatttgtcaaacaaaacccatagaatgtacagcacctagagtgaatcctaatgtatcctatggactttgggtgttatgatgtgtcattgtagggtcatcaattgtaacaaatgtaccactctggtgcctgatgttgatagtaggggaggctgagcctgtgttggggcagggagcacatgggaactgaactctataatttctgcttaattttgctgggaacctaaaactgctctgaaaaatagtttatttaaaaaagtaagatctatgaaatttttttttgtcaaaaaatatcctaagtgtagttcttttgcatttccgtggacctttaatttttctgcctgtcagtagtcctaatatttttttaaaaaaactttttgtcccatctcgataatttggaagcttgcattcccagctctcttgctgacttgttcggcataattatggagacttacagcaaatgagaattgaatacttcgaaggctttgaatgaaaggtgccaggtaaaagcaaagcaattttattgttagagtgggggattatgagtcagaaattttaaggtcagctgggcacggtggctcacgcctgtaatcccagcacttttggaggccaagatgggcagatcacttgaggtcaggagtttgagaccagcctggccaacatggcgaaaccccatctctactaaaaatacaaaaaaattagccaggcgtggtggcacacacctgtaatcccagctactcgggtggtggaggcaggagaaatgcttgaacctgggaggtggaggttgcagtgaaccactgcactccagcctgtgcaacagagcttgactctgtctcaaaacagaaaagaaattttaaggtctgctcttcactgtgtgaccctggaggcaaggcgctgatgaaatgagtatgtgaaccaccaaaatcatggtgaagaggtacctgctaaccaaattcagactttggagcagctgtgtttcctcaatgtggcccatatgtaaatcaaatttgggcaaatcacgtcatttcacatacacttggggaatctgatttttgaatgaactttattggaatcctttggaaaagcaaagcataattttgtaatgcaagtaaccatccactaatttatatttttttaaggcagggttttgtgaggtgggatttcagtttttgtaacacactgtcactcctctgccatttaaaatcagattatacctgggagagaaggataactctgggaagttgcattaactccttcagacctgaagaaggcatttagtcaattattgtttctgggaactaaataatacccttgtcactcaaaaaatttaaaatagcctttgtaagtggctcctcagtctctaagagaacatgactcattctttctttgtaacttgaaagaaatccaagtgtcagaagacactgggaaatggacttaagttacacttctaaacatcagtactagagatcttaaatattaggaaaccaatatgatattggtttaaagttgatggttggagccactgtattaggatgaaagggcaagggattgactggcagtgctttctagaatattccttggggaaattcttgctggcagcattaaggctcctgagctctggctgtactctgtgtaccataggctgtcctgttcttttgtccagaaagcccactccctgcttttctaactgcctcatggttacacatggcctcataatgtttcttctgccagcttaatttatggttgctttcccctcaagcagcctttggatccatcttctgcatataaccagtgaaaagaaacggagtatattagaagatgccttgcattagtgctgggagatggattgcattcctgtacttcttaaaacccatgtccttgataatacaagatggagctgtggagggtgaggttctccatgtctgggttcgcctttgcctttcattgacctcggtggctgccagtcaatggaaaaatatgatcagggttcaccctatggaatcattgcttaatatcatagatgactcattggaattagtgttgttagaaaatcacttccagatgtggagcagaaacttttccaaaagagagaaatacactctggaaaactgggttttattatttttttaaatgatcttagggccagaattaaatctgcttgtgcgtggttagtcaacatatatttggagttctaagtagtacaatcctgttcacttcctttagactgacatccacataagtgggggctgcctttagcctgcttccttatcctctgtcaacttctgccctctccacatctcccatcttctcacagtgatgaatggcttggaagccttatctactccctcaggttccggtctctcattccttatcattaccagcaaaatttattgagcattcctagatactgtgaaggatggaagaaacatctagttggaaagcaatagaagttttggtcatatagctaagtgactgagaatgagctctggtgtccacttctgagttgaaatgccactttctggctgtggaatattgggaaacttactcaacctttttaagtcccagtttctttgtttataaaataggagtgatggtgataatcatacctaccgcataaggtaagcatgaggcctaaagggataatccatggtcaaccctttgcataggctaagtgttagctattattattcatcaattcacctccgtgtgtagtttttgtatgaagggggaacatgaaccattagttctagactgacactctccaaaaagcaaccacagtgtttgaattttggaattctctttaagtttatttcactgcagcagagaattcactggcttctcatattcactacatttttagttgtgccctgttaaaagagggaatgtgttgtcatctccttggaagcaccacatgacagactttgtagttcacgcaatagtcagaaggaaagtatttgtaaatagcataccctggagctcttgcaaaagccacgtctattctaataaggtgtttttggtaaatgaaatcttatgttttccatcctacttatttttcacaacgtaacctattatcacattgtatttgagtagttttctattgaatatgtattctcccctccctccatctcaaatgtaacatatcaataagtgtgtttctatactagaatgtggtaaaaaaaacatttctaaaacttgaaaactgcactagaagaagaaaatatcataaccattcctattacatagagatttacattaatatctttactctttaaagcattgaaaatgtttgggaattcacaaaactgctgcagaatctgctgtagtggttaagagcatgcacttggccaggctcattcctgtaatcccagcacttggggaggctgaggcaggcagatcacttgaggccaggagtttgagaacagccctgccaacaaagcaaaaccccgtctctactaaaaatacaaaaatttagctgggtgtggtggcgggcacctgtagtcccagctactcaggaagctgaggcaggagaattgcttgaacccagggggcggaggttgcaatgagtgatattgcaccactgcactccagcctggggtcagagtgagactttgtctaaaaaaaaaaagcatgcactccagagttaaatagagcctggctttgaatcctgactatactggttttctgttgctgcatagcaaattaccacatacttagcagcttaaaataacacacttattatttcacagtcagaagtgtaggcatggctcagctggattctctgctcagggttttacaggtgttggcaggactgcattcttatccagaagctcagagcttttccaagctcattcaagatagcacaatttggttccttgaagtagttgaaatggtcccattcagctgggggttgctgtcacctcctagaggacatcctcaggtcctggacagataggcctctcatcatatggcagtttacttctttaaatccagcaggtgtatctctctcttcaggatgggcccagttcctcttctagagatcacttgattaggtcgggcccacctggaatcctctctgttttgattaactcacagtcagttgattcctgacctaatcagggtagggatatctctcaatattcacaggtcccgcttacattcaagaggagaattaaacagggtgagtagaccaggaggcaagaattctaggggcatctcagaatttggcgtactacgctgactctatttgctcacttgggcaagtttctgacctctcttaatctgttttcccattgataaaatgtgagtagtgatagtattctctacctcatacagtcattgctaaaattaaatgaggtaacgcatgtaatgcatttcgcatagtacctggtgcttagcaagctttcaataaatgttagaagcataatagagaagagttacatttcttcctcctgtcctacattttctttcatttccccaccctcataatgaaatggctttgagggtaggacatatggtcacatgctaaagaagttgagtttttgcccttaggatttgaattaaatacaaaaaagaacttactgagcataaaggttgtttaacattgaaatttctaagccatttgtatgtctaggtggagacctttctagaaatatccttctcattggattcttggttaaatgaatgcatgtgcagcaggcagttcatggggttttaggtgtgcttcctaggtaagaagattttaggttatttactctgcttatgaaaagacagtttggtaggttggtgatctgtaattgtcaatacctttcaaaaacaaatcagtactttgtagagcgagaaatttcagtttacaggacctgcactgtgcactgtgtttctcacgtttagtaaggatattcaacagttcagcctcacgatagtcctgaaatttggactgagtttattcacataagctactgagacacagccatttctagaggatttgagtatagttccggggctattcctagaagaaaatgaatatgtattgctttttctcattgcctgtgtaaattgatcatactcaataatacttagaaaacaaactcccatgtgacaaatagttggttcgaaggcccattttgcaggggggactgaagagaaaggaaataaggggcagagagacaagaaggggagtttgatcctccgagatggaactgaacttgggtgtcacttttcacaataattactcaagcattcctctccattcagtagtgacaaatctgcatgtttgtcttctatgtgagaagtttggaagtttgagtgtgtagttaagaaccagccagaaacagagagctggtagggctgaggaatcgtataagcctgtaagatctatgtcctccccaccctgcctgtttgcccttgctgggctcactaccacacccagatgagtttcctttctgtgactgtcattagtacacaagtgccccaccgcattagctgcctaaaaaggagccaagttgggggacgattgatgagtttgtgacctcattgagaatacctcagttcttgttccttcacccacagaagggtaaaaaggaggtattaggcgtaccttctccatccatatttcaggctgtctgtttgctccctaaaaattcaacccataccttctttaaaaaataaagttgattacattaactttatttgtcggtgtcctctgatttttttctcaaatcagaggacactaacaggagagtaaaaaggcaacccacagaatgggcaaaagtatttgtaaagcatatatctgataagagattaatgtccagaatagataaagaactcctataatgcaacaacaacaacaaacttgatttaagtcaggcaaaggacttaaatagacatttctttgaagatgataaacaaatggccaataagcacgggaaaagatactcaaaaccattagtcatcagggaaatacaaatgaaaaccacaacgagataccacctcacacctgttctgatggttgttattcaaaaaactggaaaataagtgttgaggaacacgggcggggcggacctggaacccttgtgcattgctggtgggtaatgtaaaatggtacaaccactatggaaaacagttaagtggttcctcagaaagttaaatatagaattaccatataatagactgggagaggtggctcacacctgtaatgccagcattttgggagaggcaggcagatcacatgaggtcaggagtttgagacaagcctggccaacatggtaaaaccccatctctactaaaaaatatgaaaattagctgggcgtggtggcgtgtgcctgtaatctcagctactcaggaggctgaggcaggagaatcacttgaacccaggaggcggaggttgcagtgagccaaaatagcgccactgcactccagtctgggtgacagagcgagactctgtctcaaaaaaaaaaaaaagtattaccatataacccagcaattctattaggtggaattgggaaattctccccaaaagaattgaaggaagggactcagatacttgtttcacaccactgttcatagcagcattgttcacaattgtcaaaaggtggaaacagcccagtgtccctcagcagatgaccaatggaatattattcagccttaaaaaggaaggaaattatgacacatgctacaatatgcatgaagcttgaggacattatactaagtgaaagaagccagtcacagaaagacaaattttatatgattccacatatatgaggtacctagaataggcaagtacatagagacagaaaatagaataaaggttaccagggatgggcgggggcggtgtggaggaagtgcagagttgaatgcgtacagagtttctctttgggatgatgaggaagtttggaaatgggtaatgatgatgattgcagagtaatgtgaatatagttaatgccaaatgcagacacttatatagtatatacttaacgaagtatatactttaaaatagttaaaatggtaaattttatgtatatttttaccacaataactaaaaaaaccaaattaagttgattgtatgttttggattataccagcggtacttgtttgtgctagaaaactctgggggaaaacagaaaaggaaaaaaaaagaaaaagaacgtaacacctccatttggaatacataaatctttaatgttttgatttgaccatgtttctttttaactaccctccccttgtcagcaaaaatgacaatcactttctaccacttcccgtataggtggcaaaatagtgcctacttattccctgtgaaatttccatgtcttaattcacaaacagaaaagaaagaagaaagacctgagcagtgaaaaacatcgcttccctgctgggcattctgttgtaaacctatccttagcaaggcggtagttcccaggccatgacatcttgggagcagctaccaagacaagcacaaggacctggggtcagcaggtctggcttccagctccagtcgtatgaaagatatgagccagggctttcaagtcttcagtcattctcacatcccttactaagccacagagcaacatcacatttagccatattgaatcaagtcctcctcataccgagcatggctcttgcttcagagatgtgaaggctgttatctcttgtttcctctctcagctagctgttctgtcaatggtctgtccccagggcccttcaaaaggaactctggccaagggtccctgagggagagaaagatgccagagttttacaagggctgcctttgcctgtttgtccgatgactacttgcttacagtctgaacgtgagtgctctcaggttgtggtgtttatgagaaagcaggggccagcccctgacctggccagagactgtagtttctacagtagtgccagtacattcctgggttctgggaaactttactgagctaggcccagattgctccctaagagaaacctcccaagggtcagaggaaagaggaaaaggctcattgatttaacagaggacagagtgactgatagagaaaaccattaaacatttcaattggcttttccttgaattttagaaagggacttatttgttttcccactggaaaatgggatattatttaaatatgggatgaaaattacattggaaggactggacttaaatggccagaagtccttcattgatccaagcaataatcctgttttgccagaattctctcaatagtgaaatatgtaagcagcagtgaagtaattacaccaatcttcctccttaaacacgatgggactccaaaaacatataagtgatgtcctttgaattgtcacccaccacaggaggccacataatcactccctaatgttttcattgctctaaaacccaggaatttccatctgtaagtttatgattcgtgtgagatacccagggcctttactatatagttgtatttcatgtactgtatatacttttatcattagatgagtgtctgcattttggtagtaaaggaaaactaccatttaaacaaaacaacttctactggttttattgtgtctctccaagactataattacatctgctttttttcccaattgatatagatccagtcattttacgtgaaaagatactctttcttaggctggggcttcacatagcctgttgaaatccttagaatttttaaacaccttgtgtgaaaacttagttaagaatttccctctcttacttttggagcaacaaatatttgttggtggatacatcttggaaatcaaagaggtttttgaactctggtccgaggttccttgtagtcagaaatttctcttatattactgggaacaccgtaactgctagaaatcaacttaatcagcagtatgaatccattttggaagaagaaaaaaatgaaaagagatggagaacatcaaaatgttaacagtggtcatttatggatggtggttttccaagtgacttatattttcctcattatatttttggattaaaaattcttcaacaaacatgtattgtttttataattatacaaaaccaatacatcttatatgatgacaaggcaacctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgcctggctgatttttttggtatttttagtagagatggggtttcaccatgctcaccaggcaggtctcaaactcctgaccttgtgatccgcctgccttggcctcccaaagtgctgggattacaggcgtgagccaccacgcccgaccacccatactattttctacctcccagcatttcttcgtggggtgccttgttctatgaaaacttcatatatggcattgtgaatttacaaaaagataaattagtgagtgatgattcatactattaaaagtgttcagtagcagagctcctttggacagctaccctaatgtttgcctttcagtgttttagagattgtggtcatctaggaaagattgtaagaggcagaaaatcttaattctgaaggttaggaaaatattgaccatggatttgtactttgctcatttgaagagctagggacagagcagtgaataagacaacgacactacaatcacagaactttcatttaagagggtagagagacagaaaaggaaacatcaggcactgcaccttggcacctctgaaatgggctgggatggcgaaggaagcgtaggaaatagaatagctctgggtttcagaaggtgcactgaataggaagaagtggtcacctgtacttgggtagataaggcagcctcttggggtcttgaggtggggggagtagacataaccaggcagagaggtcaggatcatcaaatatgagataacatgacccattaggaggtctacccaccctgattggaggacatggggctggaggctgaagatggagaccagatcacaagggatctaataagccttgctgaacagtttgagctttattctacagactctggtgagccactgaagggattgaaacaaagaaatactgtgatccaacatatttctcatcaaaagttggaccattttggatcaaattagccataggaaaggtgttgggaacaaattaagtacagattggcagctgatcttttccaaatgaaatattctggttaatctctgtcacacaaggacaatgcaaacattttctctctcttaaagaaaggcttttcacataagcagagtcctcactttattttcctcaatagttttgtatgcaactctaatgagtagttttccataattcagtgtattactcctggaaaacatagacaataggacaaatttttagcctatgctgtcattttatggattaatttccattaacgttgaccttctggctttcagtggataaatgtgagtaaaacatctgttcatgtcattcccttgcttaaaaaccacttctggctccccatcacctacactaggaaacagtctaaactcattgacttggcatatgtggtcctccataaacgttccttcccagctcatcttggccattcctccctgttctgtacaccccagaatcaatgaacacatggctttcttcttctttgctaagacttatgctctcttccttgcctgccatggggatttttatttcatccttcgagtctcagctcaaaagctatttcctctctgaactgccttcaccagtgatatgaatcactcccttccctgtgtctgcatggcactctctgtatcccctaccctagcccttactccattgcatcatagctcttgatttagggatctctctctccctctagcccatgagtttgttaagggcagggcccacatcttgcctgcttttgccttcccagctttgtagctccactgcctgacacatggttaatgctcagtgaatctatagaactaagttctatgttttctatttctgtttataagattccagaagagccctcggggaatgacagagcagcaagcctcacttttgtagcaggctggtctgtgaaatatatggctatggtgtaggaacctcaagcattgaaaactaaccattggaatgaagagcaacatgatttctgtactgagaactcatctcttactaaatattggagattttgttgttattgttgttgttgttttgtttcgttttgtttttggatgtataaggaagtgaggttgggtgcagtggctcatgctggtaatcccagcactttgggagtcaggcaggagggttgcttgaggccaggagtttgagaccagtctgggcaacatagggagacttcatctctacaaaaataaaaaagaaatagccaggtatggtggtggatgactgtggtcccagctactcaggagactgaggtgggaggatcccttaagcccaggaggttcggggctgcagtgagccatatactcaaaaaaaaaaaaaaaaaaaaaaaaaaaaaaaaaaaaaaacaggaagtgaagctgagtaattttatgttttacttttcttgacagcctttgagatataatcctcattctatacagcttaaccatttgaagtgtgtatatatatatatatatatattgtttttttgaaacagagtcttgctttgttgcccaggctggagtgcaatggtgccatcttggctcactgcaacctccgcctcccaagttcaagtgattctcctgcctcagcctcccgagtagctgggattacaggcgcccgccaccacatctggctaactttttgtatttttagtagaggtggggtttcaccatgatggccaggcaggtctcgaactcctgacctcaggtgatccgcccgcatcagcctcccaaagtgctgtgattagaggtgttagccaccacacccagctgaagtgtatattttcatttttagtatattcaaagatatgtgaagtcatcgccacaattttagaacattttcatcacttcaaggttatttgtttaagacagtcaaaaaacctttcatagaggtcaactcttaagacttcttttaaatggtatctctggtgatagggggtttgtcatagggaagggaattggcttaaagaagaatataaagattatagataggggcaggcttttttgtttcagaggaggatgtgtaataaaaaaaaaaaaagctgaacacccaagggatggtttaacggatgctggtctgacttaacaccctttctaaggatagagagaggctaagctattggagctttcatacggtgagaccctataaagttatagaacatggacaggaaagtgagacatgggtttctagagagacaagaattgggaaaataattacaacttattaataggagagtatgctgtaagcttaattgaacttgactgaagctacacgagagcaactgaggaccaggatgtgttagggccaatagaacggtaaaattcagggcatgatcaggaagggctttttggcaggcatctgtagacacctgcctcacctcaccaagaaaacccagttgaagaaggtgtgccggccgggcggggtggctcacacctgtaatcccagcactttgggaggccgaggcgggtggatcacgaggtcaggagatcgagaccatcctggctaacatggtgaaaccccgtctctactaaaaaatacaaaaaattagtcaggcgtggtggtgggcgcctgtagccccagctactcgggaggctgaggcaggagaatggcgtgaatccgggaggcggagcttgcagtgagccgagatcgcgccactgcaccccagcctgggcgacagagcgagactctgtctcaaaaaaaaaaaaaaaaaagaaggtgtgcctgtttagtcacgagtgggatacaggataaacgtaaatcacctcaccatatcctgaaatgttataccacaaggtggagcatctcctgacattttaaagataaagaggtaaactgaagtcaaaggagctatcactttatttactttacatagcttttatttatttatttgtttgtttgtttgtttgttgttattaatttttgagatggagattcgctcttgttgccctggctggagtgcaatgtcatggtctccgctcactgcaacctccgcctcccgggtttaagcgattctcccgcttcagccttctgagtagctgggattacaggcgcccatcaccacatctggctaatttttatatttttggtagagacagggtttcaccatgttggccgggctggtctctaactcctgatctcaggtgatctgcccaccacggcctcccaaagtgctgggattacaggcgtgagacaccacgcctggccttacatagcttttagaatatattatctcatgcagttgtataaacttaaaatattggtgggcccaaaaaaggtagagataatttcaattaatggatagattcaatgtgatggatggtggaaaactaaaatatttgtagaaaggtgtatttttgcccctatcaaggttgattttcaaactagagtctgtcagttttctttactccattatcaagagcaagttaatgagatgggtagaccgattgccagatccagtgtggaaaatgatgtgtggctgctttatagattactgagcttctctaatggagtaagtttatgctactgtgttcaaatgatacaaacaggacctctaggaggttatgttttattgaatgtaagtgatttagatggctaaatctacatacctatagaatgcctgtgcactttacagttttttctgcttaagaatgcaagttatgttagagttttgtttataaaactcaggaaaaagtcagagatgtctttttgttgttgttgttgttacaagtttaaggtgagcactaagatctgaggcaggttataaaatagttgataggcatagaatgagcacagtctaatttctccttgcaggaatgaattatttgcaataatttgtgtatgtctttgtgaactcgttaaattctttgatttgttagaaagtcattatgtatctccaaggcacatttctttttctttctgtcaataatggtgtactaaagaatagaaaaaaaattctaattttaaaaaggctctttgccattctagtctctcaattattcaagcccttcttttcatttcttaaacctcttttgtgttacttttgagtcatttaaatgcttattagcacagagtgagcacaaaaagccaggaggaattgaattcaaatcagctttcctacctgtcaacaagtttgtcgagtaaagttttggctaaattgagttttggggtagaaagttcatgaaaattctatttatccatttgtaggtaatcaaggttatttgcataatatttgaactggctgtaatgaaaaatgtttgttaatagagtgtgcactaatcatatagtgcatagtcttgtttgtttcttattgtttttaaagtaaattctttgtaagtttttaaaagtagctcttgagtttttgtaaatagttaaatagacttggaaaggggaaataattcggcagttaaaacaatttcttccctatgctaaaactctaagggaaaaaatgggttttatttttccttaatgtttctatgttagatttaaaggccttcgaaatcatattgtgctgattcttagaacattaagttgttgttcctaaattaaagctgggaagtgaaaatttaattctgaaagcatcagcaacaacttgtccttctctccttgtgtgctgccattttagcttggaaggcatacgtgtaagagcagtctctttgtactatttagctggttatccctacacaaaaacttctggctttgtagttctcagggctctctgctaggttgtgtggaggatattgaggtgaattagacatggtcccttgacaatagcgtactgttgtttttttttgtaatttgattcttaaccacttgaaattgaatctgccaactcctttcccccaagtaaaagacctaaggtgctaatccctactcactgatgacaaatgctaaattggaagcaacagcttaggaatgcaaagatccttatccaattacattacaagctctctaagccagtcatgttcagcatcatcagggcgataggaaggcaagatctcactttggtaagaatgatagcgtagtttgagtaagttttagaaaattctaaaatgcaaagttcattcaaggaaataaaatgtggtaggagctgagaaaatgatttgcttttgttaagttcaacgcataaaggtttatgtggatcatggttaagagcactggcttgggagtccatcagataaagatttgaatcccagctccacaaatatgtgacactggacctgcctaagcctcaatttcctcatctgtaaaatgggcataataaaataacctctcacaggattttggggagaattagatgagatcatagatataaaacgcttaaccgagtatacagcaatgcttaatgtaagtggtaacagaaagtacaaggcactgtttgctgaccgaaccggtgtttttgatcctgcctaggagactaagtaaaccacccaaaaagcagttaagtatccagggaatgttatatatgagtaaatgccacaatagatgggaaagacaataagggctgttggggagcgaggagggctatgctatcataagaatcaggtgagctaagtgtgggttggtaataaacatgacccactggtctcatggaaagtatgacttttcccttagccgtttactttaagaaaggtcagtgtcctgaatgcagtttgtatttagattcttatgccaagattttccccagaaaataatctttatgaaaagatgttcatgtctattttggcaagttgggttctgctagttaaaaagatgcccctcccgccccaccacatcaccattagattgtagttatgcaaagctccttcagtaattggagttcctattggggaagagacaaagagatgagctgctgaaagatggtcacatttggaacaaacaggccatggtcataacaaagtcaaatactctttatttgaaccttatgaagaaatttcttacaggctggacacagtggctcatgccagcactttgggaggcttgatgggtggatcacttgacctcaggagtttgagaccagcctgggcaacacggcaaaaccccgtctctataaaaaatacaaaaattagcctgatgtggtggcacacatgtgtagtcccagctacttgggaggctgaggtgggaggattgcctgagcccagggaggttgaggctgcagtgagctgtgatcaaactactacactccatcctgggcgacagagtaagaccttgtctcaaaaaaaaaaaaatccttacagttatggttccattattgacatgctgtatagggttcctctctagaagtctctaatctacagtggtggcatctctcacttctgtgaatcataatgcaacttttgcttctcctcatattcacacaccactcttgacagttacctagtctctgatcttacagggtttatgaataaaactagaaggcaagatgaaatgatctgagaccacataaatcgatatgatgaaattcttctgattgatctaatggggaatagagggactcacacattttagtgtgcaaacacacttgtacagttccttttttggaagaagatatggctatcaaagggcatgatagatgcacagaaattacaatagtctgtgatcagctctcacatcttgggtttatctaccttccccacgagactgtgaacttctcaagggcaaggtctgtttttttattcacctctgcattaccaggggctagcacagggccagaacctcagtaggaactcaataaatgcatctttatgctgaactcactttgttttctgtgctgccggaaattgcatgcccccagtggccattttgagtgcaaagtgttattttaagatgctctctagagaaagcactctaggctctgcttacaaatgtctgagaggaaaggagagccgaatgactaggggatctggagaaattcctaagtgaaggtcgtggagaaatgatgggaaggagagactcacctctttttgagtgtgctacttctatcccaagactgttgttatttttcataagaaaatgctcagatgtcattgaggctgtagtctgactgcaatactgcaaaaaagcacttttgggctaatcattctctttctgaaaccagtagttgccatgttcctccttgtgctgaaactcagtttggaggatggggtggtggtagtggtggcgtggtggtgcagggatgtttttgaattggctctgtgccctactgctcagctttctgcctgctttctggtatccctcccagtgtgataaaggagagattctatgatgccagtgttcacttcagacttgcagaagagacattcttagaattcttaaggagaactagtttctaaagtaaaagatttaccggtaaactaatgacctttggtatggtatttaagcagaagtaacccaggctcattttgcattgcttacagataaatattatgtgattattcttgtgtcttacacatttctaatgataacataaatatgcctgctagtcaaatgtgcttttggatacatgagtggttggatggttgaatatatacattcatgtacatttttatgtattttagtattacaagcatggttttatatttatacacatacagttacgatgataaaagatcagtcatcctgtactgcgaatgtacaggaaccaccacaaaattgtaaagtctaagtggtgatgctattagtgaccctcagtgaggatccattgtttcctctctttggaccaagaagtggactgcaactgaatctattctgacgagtttccttttttgctatctgtcctttccacttatattagaaataaaattatctcaatttatggagctgtgcatttcttcccatttgtagagtttgcacatagaaagctcattgagatttggtccttagtggcctgagtaagcaacggaaaagtgtactgcatcccacaccatggtaccaaaattggcatttttattttactagagatagaaaaatgcaatttattctcctttatgggatgatatgaagctttctttttcaataaatgttttcaatgaagaagatatttgatttgaagaaaaatatgaagtaaatgataatacagatggtgtggcaaatatgaggattatatgtgaataagttcgggaaactaatagaaacaaggattaggagttgggagacctgggtttgaatcctggttcagctcctaatgtagacagatgaacttaggcctctgagccagtttcctgatggataaagttgaaatgatggtattttccttgtctacttgacaaagcgtttggtaacaaacagaatgcatatgaaagtgttttcttaagactgcaaagtgaccttgaaatgaattaacaaaaaatactaatattattagcaagttattcaagaaaacttaggagtcagtgaatgaaaacttttaagaacaaatcattttgttttgttttgttttccccatggtgaaaactgagttggttccaaatttaggttgacggttttcctgtcactacttacgggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctcacttatatgtgaaatctaaaacaatcaaactcatagaagcagggtagaatggtggttaccaggggctgggggcaaagtgggggagatggtagtcaatggtgggatacaaagtctcagttaaacaggaagaataagtttggtttttttgagatcaatagtatagcatgctgaatatgcctaataattgagtactgtacatcttatcactaagaataaatttctcatgttctcatcacaagaaatgttaaatatttgaggtgatagatataactagcttaatttcatcattctacattgtattaaaaatcataacaccactttgtaccccataaattaaaaaaataagtgattcattttgacatattctttccatattaatttggagctacattagaaagctgaaggagggccaggcatggtggctcatgcctgtaattccagtactttgggaggtcaaggcggggggatcacctgagctcaggagttcgagaccagcctggccaacatggtgaaaccctgtctctactaaaaatacaaagattagctgggtgtggtggcaggcacctgtaatcccacctactcgggaggctgaggcaggagaatcgcttgaacccaggaggtggaggttgcagtgagctgagatcacgccattgcactccagcctgggcaacaagagcaaaactccatctcaaaaaaaaaaaaaaaaaaaaaaaaaggaaaagaaaagaaaaaagaaagctgaaggaggattttcttttttttctttttcaaatatacttgaagtaggtacttgtaaaattattgtacagagaagttgacagattcaacaggttaaaacattgaaatttgaggactgtttttgcaatctgtactaggaaaatagttggcaccaaaagcaagacttagattatttttagtgcctcaagcttgctttcttagataggacttattcattcaacttctctgagaaattgatctcagactgtgagcgttagagctggaagatgcagtcagtttccttttgagtccatggaaacacggtagatatggccgaaaggggtcagatttttctgtcagaaaatctgaatttctcaaataggattttttccttttatttcaactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaagaaaagcagagcctttgcagtcacagacctgggtttgaattccagttctgaaggcaggcaagttacttaacctcagttaggtccagagtctctgcatctgtaaaatggggataatgattcaatctgtttcatattgctatgagtgttacatgaaaaaatgtacagaaagcgcttagcacagtgcctggcatatagaaagggctcagtaaatgtgaactgttaccactactcttattatgttacatcctggctttcttagcatcactgaccctgcttcttgttactttagcttcagtctgggtcctactgtcaatggccagctcgcctagaagtccagcagggatccactgactttgtcaccttgaacctaaccctttcataacctgcccaagggatcaagcatctctagtatctatgcctgccctggatatgctggaacttagtatgcccatgggacagtgtccctggtacagagtaggaacatgaatgttgatactttctcctccaacgttgcccagagagtagtacagatgcagtaaataccaacaggcacacttccaagtatgccactttttgttttacttaaaattcaataatttttagaaggcacacagattaagtagaataacacagttctatttctccagaactttttttttttttttggagagacaggatcttgctctgttgcccagatataagtggcacaatcacggatcactacaacctcaacctcccaggctcaagtgatcctcctgcctcagcctcccgagtggctgggactacaggcatgggctatcacacccagctaatttttgtactttttgttgagatggggttttctcatgttgcccaggctgatctctaattcctgggctcaagtcatccaccttcctcagcctcccaaagtactgggattacaggcatgagccaccatgcccagccagaactctttatctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagacacagttaacccataaaggaagatcccagtactagtaattgccaaatggttttagaaagcctgtcggcatagtaccagagttttaaaaagtggatatatatgtacttttcctatatttcaaattcaagattcctattttctttcagtgtattaaaacctatagcacagattggcacgtggtaaactacaagtatgaggacttctctggggactttcgaatgttgccatggtaagtttagcattccagggaaacatgcaacaggagaattattaagcttttttaccttgttaaaaccacttgtgaggccgggtgcagtggctcacgcctgtaatcccagcactttgggaggccgaggcgggcagatcacaaggtcaggagatcgagaccatcctggctaacacggtgaaaccctgtctctactaaaaatacaaaaaattagccgggcgtggtggcaggcgcctgtagtctcagctacttgggagggtgaggcaggacaatgttgtaaacccgggaggcggaggttgcagtgagcggagatcatgccatcacactccagcttgggcgacagatagagactccatctcaaaacaaacaaacaccacttgtgaaacctttcagttataatttgtaataaagcaaatcttcaaggaacctgcatgtttggttaaatgcagtgttttggttaattgaataggttttaactttcctctttgaaattccaaaatgtatgagagctcactttttggctttagtgaacctgtattgatcataaactaaaatatagctgatgatggataatgtagtgagcattttccagtagtgtcagtgaaaaagcttgatgataattagttcagtttgatgaacctagccatcccttggaaaaagtgcatctctttcagttgaattgaaggaatggcatgagcacactggcccaggagccagactgttggggctcaaatcttatttctaccacttactagctggatgaccatggctcagtcacttaacctgtttgagctctccattttctcatctctagcactaattcctcacaggatgtcatatgggaaatgtttttggaacaaatagcagaggaataagacatttgtttagccttttgtagttttcagagcactttccaaaagaggagaaaactgagtcctatatgacagcctggtccttgggaaaaaaaaagaaaaagaaaaagaaaacagagtcctaaaatgaccagtccaaggtcatacagcaaacaaatgcaagagccagaattacactgttgcttttttttttttttttttttttttttttttttgagacagagtttcgctcttgtcacccaggctggagtgcagtggcgcgatctcggctcactgcaacctctgcctcccgggttcaggtgattcttctgcctcagcctcctgagtagctgggcttacaggcacccgccatcacccccagttaattttttttttttttttaatttttggtagagacggggtttcacccttttggccaggctggtcttgaactcctgacctcaggtgatccacccgcctctgcctcccaaagtgttgggattacaggtttgagccaccacgcctggcctgtgttgctttttgacccggggaaggagaagttctgccaccactaacagctctggcacaggttccttagcaacttctgccctccctaagtttctgggcttagttatgtcttcgctgctggccacatatgtggaagtccttacagaaacacaaacttacagtaagtttactcagaggggataatctgaatttggaaaggagaataggatgtcttggcattttctcgtttgtgaaagaaagaaatctgctcatcttgcttttactgttgttgtcattattgttgtgtttttgtgttgtttttctttttttttttggtctttttagtgtctaagacagttctcttatatttgcagtaaatctttgagaccagaaaagattcctaatcatgtatttgagatagatgaagactgtgagaaagatgaggtaagaatgggggcaacagttggggtaactgtgctagtttcctcacggtcactttgctgaaaaagatttcaaagggaatttcttgagaaaatatgaaggaaataattattctggaatgatctgtggccagctttcaaaccgggtgcttttcaattttttttttaattactgtatttccaagtagggtttaggaaaaaaaatcaagtgagaggggctatgatttgtacataaacatgttcccccacctgtgggacatgcttgtggagttgcttttcttgagttgggcatgtggtgtggtgattcatctggactctcctgcctgatagattcctcttgggacagatggcccggatgtctgtgacatttcgaggtgcagttcgactgtttacataatgcagaagatttcccagaagagagcccataccattcagtaaatactgagtgcctactgtgtgcatagcacagagcctttcattctacagtcaactattttaaatcctcacggggaagaggggactttatgttttaattaggaaatgggcagggcctcattctgtgcccctaaatgtttcgctaattagatggcaggctggctgttgttttactgataatttttgttctatttcaggactcatcttctttatgttctcagaagggtggtgtgataaaacaaggctggttgcataaagcaaatgtaaatagtaccatcacagtaaccatgaaggtaggaagtagttattatattattccatcattttaatgatattggcataagtagtctatctggaaacaatatttattttacaaagagccctagcaaaaaaaaaaaaaaaaaaaaaggagaggattctcacagacgtatggaatttaaaaaatctaaaacatcaggataaatttagaagtgcaactttttaaagacatataatgtaatgattatctggtgaatcaggatgtttaaaaaggaggctgtcagttgaaggaggaaaatagctttgaaaaatgggcatcaaagtttcatatgtagaaatgaccttaatgagtggaaggacaagtaatccatttctttagcaaatattaattaggtacttattacatattagtcactgtggggaaatatgtagatatctaagatgtggtccttggtctcagcctctagactagacaagaaatatactattttaactagtatacaaagcagtcctttagtgcagtgagaacagtctaactagaaagttttgtagtttgacaggatagtgagtttgcataaggggtttaagtgagctaaaagttgaaacgttgaaaaggataaaattgggctgggtgcagtagctcacacctgtagtccctccttctttgggaggccgaggtgggtggattgcttgagggcaggagttcgagaccagcctgtgcaacatgatgaaaccccatctctacaaaaactacaaaaattagcctggcgtgatagcacacacctgtagtcccagctactcaggagactgaggtgggagaatcccttgatcccaggagatggaggttgcagtgagccaagatggcactactgcattccagcctgggcaacagagggagagtgtatctcaaaaataaatagataattttttttttttttacaaaaaaggataaaattgtgcagagccttgaacaccttggacatgaggttcacttatttgggaggctgtaaagagccattaaaatccaaagggaaaacaagctacatgaggattctgagcagaaaaacaaattatgctctgataccaaatataactgttctttcagatattcaatataaaatcatgtggttttctgaggatgattcacacttgcattaagtattgaaggtcattctatctttcacacaggctgcaagtagaaaccgtgggtatctaccaagggaagactcaaattttatcttaatttaatattttgcctgctgccttccctttggtgatcatgtcctgttctcactttcattttcaagccctgaaaataatgaatccaagttgtaggatacttcctgtatatcgcttgcacctaagcatgggcatcagcaagtggtgataataagagaaaccatttattaaggacttaatacgtaccagacaccatactgggtgttttatattctgtatcttgtttaattctcatggctgccctatgcaataggtactgctaactattcttagtttatagatttggaaagtgaagctcagagaaattcaataattaacccaaggtcccacagctccaagttttcagaggtaggatttgaacctaggcaggctgatgtcagagcctatgctcttaaccagtatactatcagtgctcactagctgaatgagactcaagggtttattaacaatatatttcgtgccagagttatcaggttcagaaatgtacgtgaaggttacatttctgtgtggattatcagaaaatggttgtatcgtttttgactgcattccctttcccgcagattctcaaaatattcaaatagggccaggcaggaggctcatacctgtaatcccagcactttgggaggccaaggcaggaggatcgcttgagcccaggagttcgaggctgcagtgagctatgatcacaccactgcactccagcctgggcaacagaattagatgctgtctctaaattaaataaataaatgcatgaaggaatgaatggttttaaccacatttaagccttagcctcacattaagtaaatgtgcaaaaatctggattcataaaataagatgttaggaaattaatatctttacagaataattcgccacagattcctttagtttaatacctttcaactttaatttgccttacaaacaacttctaattttgtaggagtccatatattataagccaaaaagcacatgctttacattttctctcataatttgtgaaatacacattgattgattgatgtgataggaggaattgatggcctctcaaagatgtccatgtcttaatccctggaaccagtcaatggtcccctacatggcaaagaggaattaaaattactaatcggcaggagggacggtatccacaattatgcgggtgggcccagtgcaatttcaagaaccccataagtggaagagggaggcagaaaaggacagtcagggaaagagatgtaaggatagtcagggaaagagatgtgagaacagaaggagggccagagagagatgctgtcttgctggctttgagggtacagaaaagactcacaggccgagaaatgcaggcagcttctagaagccggaaaaggtaagaaaatggattctcccatgcagcatccagaaaggaacatagccctgctgacaccttgaatttagcccagtgagacccatgtcagacttctaacctgcgaaactataagataataaatttgtgctattttaagccatcaaatttgtgctaatttattacaacagcaataggaaactaatacaattagttaggcaaaggttgattgttcagcttgtgtgtttcttatccctgagcttggaaactctagcactaacagtgaccaggcgggagccataaattcatagagtgtgtgatgggtccgaggcaacctggtgaccacatagcccacagctgaaggggacagctgccacttgtctccagctaattgttgttttgctgcagctgagctaggctctttgctttgcctctttttatcctcagctgctcatattctgtgtgtgtgtgtgtgtgtgtgtgatcattaacatataaaactttttttttttttgagatggctcctagctctgttgcaccaggatggagtgcagaggtgcaatctcagctcactgcaacctccacctcccgggtttaagccattctcctgcctcagcctcctgtgtagctgggattacaggtgcacgccaccatgcctggctaatttttgtatttttattagagacggggtctcaccatgtggccaggctcgtctcgaactcctgatctcaagtgatccacctacctcagcctcccaaagtgctgggattacaggtgtgagccactgtgctcggcctatttctttctttttaaaatctctaccaaacatcaggcaaaggaaggaaaagaggaataaaccaagttaattggtcatatgaagctacacaacttttatgtttatttttatcatttatttatttgtttttgagacagtctcactgtgtcgcccaggctggagtgcagtggcgtgatcacggctcactgcagtctcaaactcccaggctcaagcagtcctcccacttcagcctcccaagtagctgggaccacaggcacatagcaccgtgcccagctaattttgtttgtttgtttgtttgtttttgatagagatggggtctccctatgttgtgcaggctggtctcaaactcttggactcaagtgatcctcccaccttgtcctcccaaaattctgagattacaggcatcagccaccatgcctggctactacacagcttaaaaaaagttaataggaaatactttgaaatgcaaaggccatattgaggtttgggagctgtttctggttatgagtttcctttatccccactcttttccattataaattatgaatctccattttgaatttcaaactcttctgatttcatctcctgagccatagcagtagtgttgtatttcagaatttgtcacagctagaatgggaatcagaggaaggttcagctagaaccttctgaggcattttgccaagattactttttcctctaataattgtattttgggccaggcgtggtagttcatgcctataatcccagcagtttgggaagccaatatgggaggatcacttgaacccaggagtttaagaccagcctaggcaacatagcgagaccctgtctctacaaaaatgaacaaaattagccatgtgaattggtgctcccctgtagtcccaggtacttgggacattgaagtaggaggatcacttcagcctgggaggtcgaggctgtagtgaggcgagattgagccactgcactccagcctgggtgacagagtgacaccttatctcaaaaaaaaaaagtgttttaactgttatttagttcaacattattgaaattagttggaactgcagtgttgacacatcattttttcatgttctctttctgtatcaatacagggcaagtgagtgtatggggcagaggattgaaaagggggagcagttttatagtttccaggctagaacttgaagtgaaggccaaagcacaagtccaggcctatgaacaaaggcacactgggagagtctggtttgtacctttcagtgctctgttacagggtgggggatcatataagttcttcctgcatcacgtctggattgtttcaggcataggaggctaaagctaaagatgaggtgagcagctgacccagctcttggataattggaaaaggcagaggcagaagaactgagacaaagggttgacagagtttgagaggaaagtttctatgtattttttttctactatggtaatgtttgaagtgaagaatactaatgaagctcataagcaaatgggaagatgactcaggtgtgctattatctgagtcatttccccaatcctggaggcaggtttatccttagagcatctggagttccctgcccgctaggaactccagcccacactggtaagaagcattggtagatttagcaaccagcacctcagggccagagcttgcagagttgagagcaaagaatcttttctttttggaaaatccaagcttcgatagcccctgcaaactcatggcaaactaactaggaagcaagagcagatctggttattaaccatgactcagtggcaaataacagcctccataagccaagcttcttccctgtgttttagctgagcttatttgatgccctgtggcttgacactggcctgcagttccctctggaattgctagggaataaaagcaaggcatcttggtgccttttagagagaggtgtacgtttaagcgtctttattcattaagaaatttctaaattttaaaaattatgtgctgggcatagtggctcatgcctgtaatcttagcactttgggaggccaaggcaggaagatggcttgagtttgggagttcgaaactagcctgggcaacatagcgagccctgtctcttcaaaaaataaaaaaattagctgggcatggtgacgcatgcctgtatttgcagctacttgagaagctgaggtgggaggatcgcttgagcctgggaggtcaaagctacagtgagctgtgattgcatgactgtactccagtctgactgacagagcaatactcgatctcttaaaaaaaaaattacagtcagttctttggaaagtttgaaattatgcgcaactttaaactgatcttagaaataggtctgagttgttttgctggacattttgactgttagaaataaaggaatctgcccaggcgttcatgaccagcctgagcaacatgacgaaacctcgcctctacaaaaaatacaaaggtagttagctaggcgtggtggtgcactcctatagtcccagctactctggaggcttaagtgggaggatcacctgagtttaagaggtggaggttgcagtgagccaagattgtgccactgcactccagcctgggtgacagagcgacactctgtctcaaaaaaaaaaaaaaagggagggagggaggactctaatagcaaggaagggaggaatcacatcgtgagagaaagtgcaaaaataaaacgaaggaaagagtattagaagagactcagcaaagtgcagttgataaaagggaattagaagattccaactttataagatcttttgagaaagcaaccacatggcctttaatgcaatctaaataatatagccaaactaatttgtatatgggttgctgtagacagtttaaccttcctagctagcttgccagcaagttttgcaagaacattcaagtcgacagttcttgcaatgacttgcagtgcattcaagtcgatgggctgtagggaaaagaggggctagtagaggaactaggctgagttcttcgtattggaagattataagaccacatatttataggataaaaatttatattttccccaatatatagctttccccctgctctggtcagttgttaagatataatctgtaccaccttctgaaatgggcatattttcccagaagtgcttgctgagtataacctcattgttggctgagaaacttgccctgaggagcctggactacaggaaagctgcgaataatgtgcatcactccacgagtcacagtgctctgtgcccaagcacttcctctcactgaagaggatgcatcatgcagttcttgcagaagctctgttgtactgggtgtggtggcatgtgcctgtaatcccagcaacttaagaggctgagtcaggaggatcgcttgagcccaggagtttgaagctgcagtgagctatgattgtgccactgcactccagcctgagcacaaagcgagacctcatccccttttttttttcaaaaagaaaaccccaaaaaacaaaaaaccaacgctctgttggttgtttgggtgcagtgaacatttagcacttgtaatttgctttgttcttggtattcaagttaaaacaggacaagccttatcatagtgattaatttcgtcaatttgtggtttctagttaatgaggaggtaccttgctgccactcttcaattcctggaaaagtattagagagaagttttaagatgtcatagagaatacatgatcctttagacagaaaccacaatcctaacagacccctattcatttacattctctctttcccaagtagctgctagagacatctgctttattcaacttcttttcatatcaatgaaggaatttaatgtgggtttagatagctgtgatattggacatagccttcccctggtatttagaactatttctcctaagagatataatgatatatggaggaatttaatcttcagggtggtttttcattttttaaaaaattgctgcagattcttggccaactcctgggacacccacctttatgcatctttttggctcaatttggtcacattcctctagctctctcctccccattctcagcaattaaacgctgaagtgccttgatatgatatcggggttgcaagttcaactggttgatgtatgactcacttctagtgccctttaaaatttttttggcacaaaaagagccatttgttatatatccagagtccaaaagtccttaaatccttaactcttccaggagggatttttcctcctctgcagtgggagaacatcaaatcaaatgaggatttgacctaagaaagcacatacaatattaaaataattgctaggaggtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgggagatgaagttgatttggttctttggtatcaccttgtgcctccatttctcttctgtaatatggagggcataacagtaatgaccacataaattgttactaggattcaatgaaataatacaaggaaagcacttaaccagagaccataatgcacaaagcaccccacagatgttagcaattgttgttattttatattattaggattgtgggagggccttgaatgcagtatctggcatgtgtgccttatgtgagtaattgagagtcattgattatttgagcagtgacatgctgtgctgaaatacatctgataaaataatttgtctgtaatgagaagggtggattgtagacccctcctactagacttggctttaaatcaaatagttgaactcttcagtgcccagatacggtagaattatttaagaaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttgaaaagaaaaaaaaaaaacaaaataaacttgataggactgtaaatgacatgatggagagaggtgagtgatatatcaggttgccaacgtagtggtaggggttctttagcaggatgaagttcctggcattctggtgtcattactgcaactcacttttctaagtcctgtggtttttttccccattgtttctttcatttttgtgcagaacagttctaagacccagtatgtctctgtctctcctgctttctccttttccttgctggctcttccattgtgttctgtctgagacattaggcaagttcccctacatcatttctacattgctcttggcctacctactctgcctctaaacctttgatgtatcctttctaagggcttctggttcatgcaatttagcagtaaataattacccctctaggtaacacacaataggtaaacgctcttgggatttgctgtataaaatgataaaaggttttcctactttcttttctttcttttttttttttttgacagaggatctcgctctgtcttccaggctggagtgcagtggtacaatctctgctcactgcaacctctgcctcctgggttcaagcacttctccagcctcagcctctcaagtagctgggattacaggtgtgcaccaccacgcccagctaatttttgtatttttagcagagatggggtttcaccatgttggccaggctggtctcgaactcctgacctcaggtgatccacccgcctcggcatcccaaagtactgggattacagatgtgagccgccacccccagccattttcctactttgaggatactaagtgctccaactttccttcctatgtttaatctttgatgcagctgaatgacaaaaggcctttgttcctgctccagaaggggttcaaaaaggttgtcatctggccaggcacggtagctcacacctgtaatcccaacactttgggagggtgaggtgggtagatcacttgaggccagaagttcaagaccagcctggccaacatggtgaaaccccatctctactaaaaataaaaataaaaaaaaattagccaggcgtggtggcatgcacctgtaatcccagctactcgggaggctgaggcaggagaattgcttgaatccgggaggcagaggttgcagtaagccgagatcacaccactgcactacagcctgggcaacagagcgtggctctgtctccggaaaaaaaaaaaaaaaaaagtgtgtcattccaacagcttggggccttaagcacacttggcaggacctgatcctatagaatcaaatcctttggcttgctctctgttttattgttgtgggtggtctgaatgggccactcttcaggatctgtgttcctcactgagtaaggtggggcattttcagctgtgttcaccatcaaacaaaaataataaagacgaggaggaggagaaagaagagtgtgggcattacagagaaacacaattctgttgtatgaaaccactggagaatctgctggagaatctttgctggaaatgggattattcattcattgtttattaattttgaaacattttattgagtccaggcattgttataggtactggggggttaacagcagtagatgaaacatgaaacttcatgggctagaaagagacggcaaataaaacagatagatgaataacatatttgtatagggatcactccatgaaaaagacataactgggtgctatgatgagggcaggtggtacagaaggcctcccagaggaggggagattgaagcaaagacgtgaaaggagtaagaaagtaaactgtgtggatagtgaggaaagaggattctaggctgaggaaacaggaagtacagagacccaaaggagcttacttgagatatttgagtaacagcagataagccagtgtagctggagcagaaagattagaaatagagtccaaggaaggccgggcgcggtggctcatgcctgtaatcccaacactttgggaggctgaggtgggtggatcacgaggtcagatcgagaccatcctggctaacatggtgaaaccccgtctctactaaaaatacaaaaattagccgggcatggtggcgggcgcccgtagtcccagctactcaggaggctgaggccggagaatggcgtgaacccaggaggtggagcttgcagtgagccgagatcgcgccactgtactccagcccgggagacagaatgagactctgtctcaaaaaaaaaaaaaaaaaaaaaaaaaaagagaagaaatagaatccaagaagtaatctgaggccaaatcctgtgcagttttctgggctatggtgaggattttagatcttactgtaaagtaagatgggaagccattggaggatttgggcaagattctctttgtagccattatcctattctgattccagttctatcagtgacttgcctgtgtgaaccttttttttttttttttgagacggagtcttgctgtctcgcccaggctggagtgcagtggtgtgatctcggctcactgcagcctccgcctcccgggtacaagtaattctcacctcagcctcccgagttgctgggattacaggggtgcgccaccacgcctggctaatttttgcatttttaatagagacacggtttcaccatgttggccaggctggtcttgaacttctgacttcagatgtttcacccacctcggcctcccaaagtgttgggattagaggcatgaaccaccgctcctggccgcctgtgtgaatttgaatgagctcttgatccctcagtttgctgttaggtaaaatgtggataatgatacttaccccaagaggcattaaaagaattagctattggttacaaaaggctcgcagccttcaaatgacaggtatgatatagagtaattaccattattctgtatagtcgttattttaacacctgtcttcttttagaaatgtaaaaaatatatataaacttataccctaagtagctgcattgtggaaattttttaaatgtctaggaagttatgtttctgatttccctttgatttccatgagagagatttaggatattcctttcttctttgcaaaagatatcttaaaagcttctcagaagttgaaacccaacatatatcataaaatattagaatgagaagagaccttacaatttgttgttgggcagagtctgatttctacatagagatgacttttaaaaatattccttactgtccaaactgtgtgtttctagtgtatgagaaatcacatggggagagtagcttccaggctaggaaggctgctgtgttatttgttcaagttgaatgaaattatttgtagattgtggaaaaatatgatcttacagatcatctcgtctgatgtcatcattttacaagtgagtaaactgagagaagcagagtcttgaggacaatttcactgctggttagcaggagatactggctgagaatcagtatcataagactttcaggcaactgctctttctgagtgctctttcaggcatcatattctctcctcagattcataagctacctaccctagtgtcacatttagatataattgcaatgttagaggaagtgatttgctgtaatttcatatccctttccatgtccattgtaatgatgcactttgctaatatgggaagtggtggctgccacagaatttctttgcttggtgaggcagctgtatgtgaaaaaaaaatttctcagactataatttgactgtatgccacaaatgttttgctctgtattttctcttcttctgcctctctctttgttgctggctgttgactctgcaagtggattctgtaggctgtcccactgaagcagcagaatttcagttttagatttgaacaattcaaatataaattttttcatattatttttttcatgttacttttggcctgaaagatgtattctagttttgttatagataattactgtgataactttaaaaagcaatgtgttatacaaagttagtgttcattacatgttattcatttgaaatgacctcagcatgtaattttaagccttctattcccatcattttaatgagagatgtgaaccattgtcatgaaaataagcaaataggccaggcagggtggctcacttttgggaggctgaggcagaaggatcccttgagctcaggagttcgagaccagcatgggcaacatagggagaccttgtgtctactaaaaataaaaataaaaataaagaaaataagcaaacatgcatatataatcaccattatgattaacattttcctttaatattaatctagatttcttccagcaaacttaaatgtagattaattgaatatgagaatatatgtatatattctcacatatatgagatatgtacatatatgaaagatataaatatacccacacattctctttctgttcctttgcatactaatacaataacatttaattgactggcattgcaaaacaagctgatgttttctgctaggactcttttctgttgatagcacgtagcccacatggccccttcccgagatagaagctgtagcatttatcagtctaacctgttagggtattccttacactgatatatatttttgtcattcattaaaaaaaatcaatgatatttatacaagtcaaaaataaatatcaatgttatttatttttactggtttttctaaaaagaaatgtcccttaaggcttttatatattttgcttggtcatgctatggagaaataaattgatgtttcaggtactttgccagacgttaagttgttggcaagaacgatcttgccaaataatactctttccataattaaagttctcaaaatgatcagggatcatattggataatcagatgggtaattaaaaatgaccagcttaaattttaaagccaggttcttcgaataagacaagatgcataggaatgcatttcctcaataatcaccaggagctgctcttcccatctcaccctgaagtgacttcagatctgtcatcctgggaaattgcaacttgaataagctctgcctttcactgtgacaattgcttgacatagcctgcagtttgtgacttactgaaagaagcatcaattcatcagagagctcctaatcccttttctcacctcttttatcagactgtcaaagtctgtttttaggggagaatagagggacagcatgaactcatcaggcagtccccaaccttttcctgttcctgtgggctttgctgtgagttgtagcaacaggctactccttaactattgtgaatccctaactccaaacaaatggcatagttccattaggcctgttgatttaaagctcagcacttggggcactcgacaacaactggcaggcaactaatgactctgtgcttccctgtgagtgccctgtaaattggactttcagaagcaaagacagtggtacagtgtagatgagtacatgtgtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctgaggtgggcaggtcacttgaggtcaggagttcgagactagcctaggcaacatggtgaaaccccgtctctactaaaaatacaaaaattagccaggtgtggtggcacgcacctgtaatcccagctacacaggaggctgaggcaggagaatcgcttgaacccaggagtcagaggttgcagtgagccaagacggtgccactacactgcagcctgggtgatggagtgagactccatcacaaaaaaaaaaaaaggaaagaaaatgaaccttggcatttttccatcttgattgatggcatctccgtcctccgaaacatctacactagaaagctcagaatcctcttcagtgccctgttcttgctcagtgccaatatttaaatgtttatcaagtctctttgagtctggctctaaagtgcctcttaacctcttacctcctactttcattgccctttctccagttctcccttttatcatcgctggcccaaagttgcgcttttatgcctcctgatttcttgtcttgctccagttcaacttcctaagatatagtttgggtcaatcatttgccttctccaaatcttttggctcttgatttattgtcttacagagtgaactctaaagcttttgccctgacattgaaggcccatagtgatttggcctcactgtgctttctagcctcatccttcctgaacccccttgtgtattctgtgctctggtcacaccaggctaagcattctaaagcgttgcacacatatatggcttgccttacatttttttcctcttcttgctatatataatttctccttctattcccgtttgaaccttatcttttatgactcagcttaaaggctactgccgtgaaaagttttgtgtttccttcctcaccctcgtgactaccaagtagaattaagctccacctctcctgtgctaaccattttgcttttccttctgtcatacaactaagtcacattctaattttggttaattctacacattcctttggggattacagggaccatctcttactcatttctgtttcttctataattaccagggttctgcacacagtagggacttaatgaatgtttgttgatatgaattactgaggggacacagacagaaacaggatgggaagtagagggctgagagatgatctggatgggaagtcaattgactatggaacagaagtcattattacagagccagggtggtgtggtggactagaagaacaatgggctgattaggaggaaagtgatgttagttcagcaccctcagtttacctaaatcttcattttcagaactgtgaagtgggattagtagtatctgtatactctatcaaacaagattgttgtgaggatcaaatgagaaaatacctttagggcatgatgttgtgtgcctgtagtgccagctactcaggagcctgtggcaggagcattgcttgggcccaggagtttgacgctgcagtgagatatgatcacgcctgtggaattagccagtgcactccagcctgggcagcacagtgagatctcatctctaaaaagataaattaaaaaattctaacaaatgagaaaacactttttaaaaagtataaagctctatgtgaataaaatgtgcttatatgtatgattatatattatatattcatatatatgaattcatatatattcatatatataaagaagagctttcttactggaagaacgaggcacacacaatttccggattgacctttctttgtagtgcttccctcatctttttatttttattatcatttaaaaaatttttttcttttcttttttttttttgagacagagtctcactatgttgcccaggctggagtgcagtggcgcaatctcagcttgctgcaacctccaccttctgggttcaggcgattctcctgcctagagtagctgggattagaggcacccgccaccatgcctggctaatttttgtatttttagtagagatgttgtataactttctccttagttcagttaaaaccagttcttgtcacataaccaggaaagattaggcttgtggacacatagaagggtgagaagtggaatttactgggtgaaaaggaaaaataactctcaccaaagtgagagagagtcctgctagcaggtttcccacctcacagattaaaggttttgccgggaatccttggctgtctcctgtctctgtcagagatggggtttctgcatgttggccaggctggtctcaaattcctgacctcaagtgatccgctcacctcagccacccaaagtgctgggattacaggcgtgagccgccatgctcaggcacctcatctatttatgataccgcctcccaaatattttcaaatgtataaatctttatgacttgatacagcagtttaatttcatcctttcgtagacttcaaagattagaaggaggaactttcttggttccttcttgaataatgaccatgcagtggaaaattattgattcatgagcatttcttgaaattaatgctgagggatttgaaaagggtagtatgtcatttcttttttcatgacagagaaggtggtaaagtaaaagaatgtatcagcaagcttgagaaaaggaggagacttattttccttgtgtggtggtattcagcacaggttacttccatgtattttatggagagtcacaatttaatgtgaaccaactatggttgcatggtcttattttttctttcttttttaccaagccattcttcttcttctttgcttgcttgctagctttctttctttctttctctttctttctttctgtttctttctctttctctctctctctttctctctttcgttctttccttctttcccttccttccttccttctttctttctttccttctttggagtcttgccctgtctggagtgcagtggcatgatcatatctcactgcagccttgcagccttgaactccttgctgcaggcaatccaccttagcctccaaagtgctgggattacatgcataaaccaccatgctggggcttctctttttaatttttaattttttttttgaggcaggatctcactgtgtcgccccggctggagtgtagtagtaccatcttggctcactgcacccttgaactccaaggcttaggtgatcctcccacctcagccccacgagtagctgggactacagccatgcgccatcacgcctggctatttttttttgtattttttttgtagagatgaggtttcaccgctttgctcaggctggtctcaaactcctgggcttaagcaatccgcccacctctgtctcccaaagtgctaggactacaggtgtgggccactgcccccatctttacttttttgttgctatggatatggaatatttctacatattttgggggtacatgtgatagtttgatacaagtatacaatgtgcaaatgatcgaatcagagtaattgggttatccatcacctcaagtgtgtatcatttaattgtgttaggaacattccaaatccactcttctagttatgttgaaatatacaataaattattgttaactatggtcgccctattgtgctgccaaacactgtggtcttcttttatactattgtgatacagttgatactatgcgtggtaaaatgagttaggatctatagtgccttttatggtgagatataaatttatcagatttgtttcaggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaaccagttttgaaattgtagagatgattgtcctgagtatcttaccacgatactgtattctgtagactctatattatagtagattagaaggttgtgacccatttattcatttaaatcattgccaaatctatttatatttttactttattcatcttactggacaaattagttacacaaatttggaagctccttttttttttctattttaaatttacccctcataaacttcaaagctatttttcaaaatttagggacacagtcatgatcctctaatctaggattttttttttttttttttgagacagagtctcactctatcgcccaggctggagtgcagtagcacgatctcacctcactgcaacctccgttgccgaggttcaagtgattctcctgcctcagcctcctgagtaactaggattacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacactttaaatggagggtggtgcaggaaggtgcaggtttatacgcggatgtgtattttaacctctttcatgagagttagatgtgttttgtagtaagatatatgcagttaatatttaagtctatgacattttctaattaagtttttaatttgtttaagtgggaaaggtctacagtatttaagtattacaaatatttttcctaatggaaaataccttttgaaaaaatgaaattgaggaagacgaaattttttggctttcttttccctttttctacatgagatttcgaatgaaaattttttatttagtttgaaatcggaaaatgtgcattacagttttttcttccacgaaaatatgaaataatttggggaagtctgattttgttgttgtcgttttttcttctttctttctttctctctctctcttctttctttctttctttcctttttttttttttttttttttttgagatggagttttgctcttgttgcccaggctggagtgcaatggcacgatctcggctcactgcaacctctgcctcctcaagcagttctcctgcctcagcctcccgagtagctgggattacaggcatgcaccaccacgcccgactaattttgtatttttagtagaaatggggtttctccacattggtcaggctggtctcgaactcccaacctcagatgatccacccgccttggcctctcaaagtgctgggattgcaggcgtgagccactgtgcacggcctctttttctttttttaagtgtagtcaagtacagtagtgacaaggggagaaagagtagaacaaaaagttcaatatgtaattgactgaacaatcaattgagataactcactacctttgggccagccattgttgtttttttctttttgcttcatatggttttctaattaaaaatttagtttaaaatagaaaaagtatataggctataaataatgcaaacattttccttaatgaaagtatcacacaagaaaatggaattatttggagaaaataaattttaaaaaataatttcatttccctttctccccccacggagttaaatattgctttagtgcaagttatgtgattttttttttttttgtaaaaaagtaacagtataatgggcctcagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactctgttcataagttaaacgtaggtagtccatggggttccagccttttgtgcctctcaacctaaatgctgctgactcccacgtccagatctctaagtcaggcctctcccatttttccaactacctactaccgtcaccacaaacacaacacatcccatactgaactcaccatttctactcactgtaccccaaaatctgccattcatttgtatttcacgactaagttcataacatcgttatctattgaatctcccaaattagagaccactgtgttaatcttttttttttttttctgagacaggatctcactctgtcacccaggtcggagtgcagtggcaccatcatagctcactgcagtcttgaactcttgggctcaagccatcctcccacctcagcctcccgaataaccaggattacagacctgcaccaccatgcctggctagtttttattttttatagagacaagggtctcactgtcttgcctaggctggtctcgaactcctggcctcaagcgaaattccctcctcggtctacatattagttttgatgcttcccatacccattcctgtcaattttgcatcctgcacagctcaaaaacgaaaccaaatttcgactgtcctggaacatatattgtgtggggaagacaaagaataaacacatataaaaagtaatattagaaagataaatgagagaaagggagtatagactgtcagggagtgtgcagttttctatagggagttaggaaaggtctccctgcagaagtgtcgactgatcagagacttggaaatgagggagcaagccatacagctatctgagggaagagggttcctgacagagtagcaagtgcaaaagccccggcatgggagtgtccttgttgtgctggcaaaataaccaaggaggccagtgtggctgcaagagggaagagggcaattgtggtaggagatgaggtcagagcagtgagaagagacagggaatcatgccatgtagggctttgtaggccatagtacagacttgtgacttttccattgcccttagatccgagtttcatcatctccctctaggatttctccatcactgtttaaccttagtgtaaaaagtctataaaagcttgttagatgaaaacataaaaagggttcaaatgaagaatggacagagaactgttggatttttgccattttttgtatattgatgtaaatcaatatgaatcccatctttttttgaaaatgattcatactatctcttttatagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgtatgtatgactttgccttctaccccccttgcatcagtgcattaaagaaatgtctttctcaaaataatttgtacaccaaacctccgtgacatgcaatttacctatataacaaacctgcacatgtactcctgaacctaaaatgaaagttttatatatataaaaaagaaatcttattacaataaaaaaatgaagaaacatctttgtatgactgagaactattaataattgactgtgtgaaaattccagtgccacatattatgataaatttgacatggaagaattttatacatctctttcttttgccaaaatatgactatgttctcattgtgaggattcatgaaaatcttacctactcagaatagcagatagagtaggctcttgatgttcaagaggagcatgtctcccaaacttgcaaaatcttcaaatgcgtaaattctactagataatatgttttcttctatgaaattggttcgtagcaatgagtaaggatcaccatagccatgctgggatacagatgctgtgcagtctgctaggctcggtcactattctatagcattagattcattttggtctacagagaaaattctaagtgacagctctcatggatcatttgagttgcttagaaatccttgaaactgtaagtgtaaaatcttcagagagacttttttgtgttcatctttattttttcgttctagttttgtctattaaaaataaaacagtgatgagggattctcttacaaaatagcttaaaagtacaacagacttttctgtgtgtaaagggttaatctttatgccatctggcatgaaatttctctttgtgaccatctttcaaatgccatctgtagagaggaatcatgtcttccaaaattgctgatagggcaaagcttttgtcaagtactttggtgttgactgttattagcgcttatgaaatgtatagtcaagtaagttggaacataacagaagagaagatttatttctatactgtaatattggcattattttttaggtagtttcagtaaacgtgtagcgaataaaattttattcatagaacaatttgtgttatttaaatgtagcttttgatttccatttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcccacccctgattttcatgtccattatgagtaggtcatttgaatggagcatatgggctctttatacaaggagttttacttgaaaagcaatgggcgggaactgcttgtgtcatagctgtaatgctacactcttctattctatctggagcaaagaatccctttcagaaagagcttaactgttccttggaattctgacctctgaccagactagaggccataagaagttagccgagtggattgatcatttgctcgctagacttttgcagctaaaaggaaatgagagcacggcatagaattaaaagtagaaagaggcatatgaacaaagctgttcatgttgtaaggagattgatttttttctaaataaaaatactattctttttttcctgattataataagtacattcttatgtagaaaattcaaataatataagaagtataaaaaagaaagtaaaagtctccacccaaaagacaatacctattaacattttggtaaacatcttttcagacatctctgttgtgtatatagaaatatatacacattatgtgtatgcttataaaaattatattcatgctgttttatacctactgtattcttttaatatcatatttatcatcctataccaatatctatagatcagtcatatttatatgaaaggctaacatgacatttcattgatttagctacttaagacatttctaattatttgctatcagaaataatgctgcattgaacctcttgtgcacacatcttagctcatttgttgaattatctccttagaataaattccaagcattaggatttttagggtcaaagattatgctgatttatatagatgatcaaacattggggaagactgctttacatggactgtcactgtctttttggggctgtggatttctggtggcttgtcctcaagttgtcccttatcccctgatagccccttagcttgttactgagactatagttgtcacctctgtgaacattccacaatgatggtggatgcttctgaaagagggatggagcaagtaaagtgttgtaaatatttgagaacttgctattgaattttatgtttaaaatttcctgcacaatatcaaataagtcattttaagccaatgtgtatttcccgtattacttcagtgtgtagcactcagctgtatgttcaatgcaggaagtttaaattatgatttcagatgtcatccagtttgtaatttggaacaggaagaaaatcaacatttaaaaaagatctcctgtgtgccaacattattccatcagtgtctcatgtaatcatactagtttgtgaaatgatataatcactactgtttgacagatggcgaaactgaagctcagggaggttaagtaaactgctcaccattacacagctagtagtggtgacggtaggatttgaatttaggtctgtttgaaataatttgatcaagaatattagacaaatgtaattaagtgccgaaatatataaccctagcacatgccctgccacatcctgggagctttgtaagtgctggtggctggggtagaggacctggcccattttctagcgggaggggccagcaaagtgggtaagagtcgccctggggtggggaggcatattcatgccccttggtgggaaacaaggactgggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaaatttgaaccactttgttccatgcttgctgcttgggaattcaaagctgaatcagccattacgcaggatccttataagctgtttgacttgggggaaatcattagcctcttaacactcaattttctattctgccctgtctacctccaagggttctatctggtacaaatgagataatgtgtctgaaatgcattggaaactggaaatcactatattaacaaagttggtaatatatcaaggaaaaaaacgaaattttggtagagactcagtgatagatttttccacttgaattcactagtgatgcccctttaaacaacaggcataaccaactaacatgctatgtagatgatattatatttggaaggagtcaaactggacaggaggtgttcctgttccacatgcattcaaagaaaaatgtaattttggttgcatctacattagtacatttaagtaaagtgtatggggacaaaatgagttttggattctctgtctcctacctttgcattggaagcaccagagctcttgaactgcaacaaaggaatgtcttttagaggatgatttagtttttctatattagagcagtaaagtttctttttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgttggcatattaaatggcagggatttaaaaaattattgttgagtgtccttaagtggcaatattaaaagttggcaaccctatattgtcatccagatttctagaaaattgtgaaattgtgaaattcaaatgtttggaaatcatcgctctaatctcatcctctccttttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcaccacaacctccgcctcttgggttcaagcgattctcctgcctcagcctcccaagtagctgggattacaggcatgcgccaccacacctggctaatttttgtatttttagtagagacggggtttcaccatgttagtcaggctggtctcggattcctgacctcaggcgatccacccgcctcggcctcccaaagtgctgggattacaggcgtgagctactgtgcccggccaagaatgctttctcttaaactttgctgtgcatcaaagaccctctcattttttttttcatatgtcttgctttagggaagttttctttggctttggttactgctctgactgacaccacttaattttactgcatttaaaagcagaatttatttggtagtcatggaattttttcagaaaagcagaaattatagtgagttatgtacagtataccccctatttcagagttggttgtgtttatgctttgaaaatctatcatagaatatttctggaaaacatactgaaaattcagaggcaactaatgaagtcattaaatgtgagtgtgtaattaatgtattttcttcctgatgacaaattctgccagcatgtgataactatatttcatatctgatggtaggttacattattttatccaaattttgtaaatccatgcagggatgacttaaaacaagtttcttgtttttctccctttttcaagtacaggttcactggcttgtttgtggtacagcctgtacagctcactggggcttctgtggaaaggacaccatgttctgaataattcaatcaattatgttcagtgggtgctagggagtagcataagggtaggagattctaagttaattaactcttttatttgtcactatttataatcatttcattttgggcaaggtctcaaaatgtattgtatgttggtggatgaaagatcactattgtccttgttttgcagactggtaaaaaaaaatgatagctaggggtaggtgaatggcaaagagtagcagaggttggtgtatgtaggcattatagaaggtgaagtatggcttataaatatcagcatatttttaatgctccagcctgaaaagtccattgctgctgctgctattattattgttaatagttattggctgggcacggctgggtgcagtggctcacgcctgtaatcccagcactttgggaggccgaggcgggtggatcacgaggtcaggagatcgagaccatcctggctaacgtggtgaaaccctgtctctactaaaaatacaaaaaaattagctgggcatggtggcgtgcacctgtagtgccagctactctggaggctgaggcaggagaatggcgtgaacctgggaggtggagcttgcagtgagcagagattgcgccacggcactccagcctgggcgacagagcgagactccgtctcctaaaaaaaaaaaaaaaaaaaaaaaaaaaaaaaaaaattggttattggccggccacagtggctcacgcctgtaatcccagcagtttgggaggctgaggcgggtggatcacaagatcaggagttcaagaccagcctggccaacatggtgaaaccccgtctctgctaaaaatataaaaattagccgggcgtgatggcaggcgcctgtaatcccagctactcgggaggctgagacaggagaattgcttgaacgtgggaggcggaggttgcagtgagccgagatcacagcactgtacttcagcctgggcaacagcaagactctgtctcggggaaaaaaaaagttatcaagtgctaactctgttcaaggcacttatctacgtgcttcatgtctattgtcttaaaaggtgggtactgttatccctgtctttgaagatgaggaaattgaggcccagaagtgaagcagaaagacaaaaatataaattattttccaagttcacacagcatgtggcagaacatggatcagaacccagggcacctgccttcaaagccatctctagaccactgtggcatacggtccctctttgggccataccagtagctgcttgatgccgttttaccagtagaaaagttaattttgaagtcttcaaagttagaagctttgatttccagttctaatgaggaattaaggtatttttttcctcctgaattgttttggttctcagcagtagtaaaaacttactcaaaaggctgggctggatgtttaaaagatatatgataaacctctgtttactagaaataaaggaggtatgcttagcgaaggatatgaacagacacttctcaaaagaagacatttatgtggccaacaaagatatgaataaaagctcatcatcactggtcattagagaaatgcaaatcaaaaccgcaacgagataccatctcatgctagttagaatggcggtcattaaaaagtcaggaaacaacagacgctagagaggatgtggagaaataggaacgcttttacactgttggtgggagtgtaaattagtttgaccattgtggaagacaatgtcacgatcctcaaggatctagaaccagaaacaacatttgacccagcagtcccattactgggtatatacccaaaggattataaatcattctactataaagacacatgcacatgtatgtttattgtggcactgttcataatagcaaagacttgggaccaacccaaatgtccaacaatgatgactggataaagaaaatgtggcacatatacaccatggaatactatgcagccataaaaaaggatgagttcatgtcctttgcagggacatggatgaagctaggaaccttcattctcaacaaactaacacaaaaacagaaaaccaaacaccgcatgttctcactcataggtgggagttgaacaatgagaatacatggacatggggaagggaacatcacacaccggagcctttcggtgggttggggggctaggggagggataacattaggagaaatacctaatgtagatgataggttgatgggtacagcaaaccaccatggcacatgtatacctgtgtaacaaacctgcacattctgcacatgtattccagaacttaaagtgtatatatacactttatatatacacacatatatatatatgaagtaggaacaatggagttaattaatgcctattaccacatcttcagaggtatgctggggggaaatatgtttcaggctatagctgcttccagtgtgttgggtgcgtgtatattgttttccattttagcagcagaatagttgcttaaaaatgggagaagaggaggggaagggaataattcaagttcatataggaaactatacatatatagtcatccctcagtatccatggggcattggttccaggatctcccacagataccaagatctgcaaatgctgaagtctctgatataaaattacgtagtatttgcatgtaacctattcacatcctcccatgtactttaagtcatctgtagattacttataatacctaatgcaatgtaaatgctatataaatagttgttatactgtattctttagtgaataatgacaagaaagtctatttgtgttcagtacagacacagttcttttttccaaatattttttatccatggttttttgaatccacggatgcggagcctgtggatacagagaaccgactctacattgtaatctccccatataaatttatccttatgctttttatgaactttatggaaatatacttcacctttgataaaatgtacatattttaaatgtctagcttcatgaattttcatgaatgtatacagtcacgtaaccaccaccccaaccagatatggaacatgtctattaccccagaaagtttcctcatgtcccttgtccattcagccatcttatccctgtcccaggcaaccactgatctgattttcattgcagatgacttttaatctcttttgcaccttcatataaatggaatcatgcagtatgtcctctgatgtttgctttcttgtactcagtgttcttgagattcatccatattgttgtgtgaatatgtagttcattttgagcagtatcccattgcgtgaatatacagcagtttgcttacccattcactttttctgggttattactagtttggagctatagcaaataaattggctgtgaacatttatttatataaatttttgttaaattgctgctgcgcaaattaagaacattcatgtaccatgtggaaatatgcctaggagtggaattgcaggattgtagagtgatgggtgattaacttaatgagaaaccgccaaactgtttccaaagtggtttcaccattttacatcccgaccattgctaattttatcttaatttatcaacatggaatttttttttttaaaaaaatgcttctgttgctgttttagacccattttcaaagatactcaaggctctcttgatctggatgggagattttctcctctgtataaacaagacagtagcaagctttcaagtgaagacattctcaagttgctctcagaatataagaagtaagtgtttggtgtttctgcaataagtaaatataatagatgaatcctcagttttttaaaatgatgaatgtgagtcatatatgggaaaaacagaatgattaaaattgtaagtttggatagagggtaaccagtgcattcagtaatcataattttaactctaaaatattattattttatacccaggccagaaaagaccaaactgcagattattcctgggcagctaaacatcacagtagaatgtgttcctgtggatttatcaagtaagaacatattgcaaataaaccttaagcataatgtttgaatgtcaggttgttatcctttcaatatttttcttgaggtttacgtggcatattagtttcccagggttgccatagcacaaagtactgttacaaattgggtggcttaagacaacaaacatttattctctcacagttccagaggctagaagtccaaaattaaggtgtttgcagggccatgctctctctgaatgctctagggaagagccattccttgcctcttcctgccttccagtagctcccagctaaccttggcatcagttggcttgtggctgcatcactccaacttctcctctgtcatcacatgaccttcttataaggacaccagtcattggatttaaggcccatctaatctagtatgacctcatcttaactaattgcatctacaaatatcccatttctaaataaagtcacattctgaggttccgggtggacatgaattttgagtgggggcgtggatgcttttcaacccagtatgcacgatgaatagttacagattaggaagtgaattgagttgattttatcagatgctgtttcatatatacgaagttgtgagtgtgtcccagtcaggttctattgccttttgcctttggtaacttttacttctgtcatcaactaagagatgaaaaaggagaaggatttcttttcttgtctaaggacaagaatccaagatcccaggagaaaaatagaagacacaaaacacaatttgcaagagataaaatgaagtagctagtaaatatgtgaaaaatattcaatcttagtaataatgccagtaaggcaaattaaacaatatgcttttgctcatccatcaaatctattaaaatgtttaaagtgaagctacctaatgctggctaggttttggccaggtggtatcacctatcatgagtaggagtacagtttggtaatagatatccatagatgttcataagtagggcattccaattctgagagtatatgcattcattcactgaataactatctattgagtaaacgtttattgactaccaacgaggtgctttaaacgtagggagtttaaagtctagaaggagtgacagatagtatgcaagcaaacgagttgtattactccgtttttcacacggctataaagatactacccaagactgggtaatttataaaggagagaggtttaattgactcacagttctgtatggctggggaggcctcaggaaacttaaaatcgtggcagaaggggaagcaggcacgtcttttgtggtggcaggcgagataaatagtgaatgaaagaggaacttccaaacacttataaaaccatcagatctcatgagaactcactcactatcacaagaacagcatgggggaaaccgccccatgatacattcacctcccaccaggtctctccctcaacacctggggattacaattcatggtgagatttgggtggagacacaaagcctaaccatatcacaagggcagctgtaaaaagggtagccagggaacacctgtcttaagctcaggaactgaagagggagaaagagagccagcatgtggtgattgggactgaacattttcagactgagggcatcacatacgttgtaaagaccatcacatatatatgtaaagaccttgaggtgagaccaagctgggtttgcatgaacagaagggaatccagtatagctctagtgtagtatgtgatgggaacagtggagataggagataaaataggaagcatcaggtcatgtaaggaattgtgttgactgtggtaatgccttaaaaaattgaattttattctaaatgcagtgagaagtcaataaagaatagtaaatggaggtgtggcatccactttatattttaaaacatctaagagtacaatggattattttttcctaaagaagcaatttgaaatctaggcagaaatggatccataaagatgttctttgcagtgttatttatattggaggaaaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgccaaagtctcaacagtagttatctctgggtggcggaatgagcaactgtccttgtctaccttcactgtctacctccagatgctctgttataggcatgtatcactgtaataatcagaaaagcaaatccaacaaaaaatacagcatcctcaggtccaactctccctgggtcttccttcatcattactgctctgcagcaaggaccagcagtcttagagccccttaagtatatgaataacctttactacagtgacgatttcaataacatatgctgctaaacttctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaatacctgtcacaccacagtgcctttatatttttactctttataactgtaacccatcaatcagggacctgaaagagaagtcagaacatctagccagcaagaagtgtttatttggctccccatttctcttgcatcagcctaaatcagacagatggatgctgggtcttacactcaaaccacctagggaaacaggctggaatgcccctgactaagtaattgaataatagcccctacctttgaaaagagattttttttttttatgtatacagagaaacttaaattaaggatttgctggctcaaattctgtatgttttctctggttctctgttcagtggagatgagaacaactgctctatttcctccatgcaatatccttttgtagacccaatgactcttaggttacttctcagcagttcttgcaaattgccttcataaccatatttaagaagagttggatattcacttatatggagtttcaatttcatttcttagctggcctggattgctcactctaaagtaacagaatgaggcaattagtacgttggcatgctgactccatattcatccttgagcctattaggcctatagaagtgaaaaaatcccactagaaatgaaattggatctttccttggaaccatagaaagccttacatttattttattggtataacagaaagccactgatattttaaaatgtggctcataaagtgccacatttaaaaatgtgagagaacagcaagcttgtctgtagcttaatacacattcaactttttaattcctttaggccaggaatgtgtctgctggagctttttaaacacgcttcaccttgcccactgcacaaagagcgttcaacaaatgttgccgactggttgagggggagcctctcatattaagaaatgcaagtagcataagagaagtaagctttacaggcctggtttgagacaagtatttcccttccaaatgagtaggcctgttcagctccttactgtcaactagtttgagatcgtgtttctttgatggctggaaattcagaagcatccatacagccaagttacatggtgtctcatttggtgtctggagtgactgtgtaaatgattgggaatttacaggctcacggtgactgccaggtgggcttggccatggccctatagtcacagatgcctctaactatatgtggttccatggcatcacatttacagacctgcatttagagcggtgactctgtttctttcttttgcagtgtatttatggaaaacctgcagggtctgtttttaccacaaatgcttatgctgttgtctcgcatcacaaccaaaatccagagttctatgatgaggtaaaaatatattatcctgacatttctaaaacacagtggttggaattctttttctctttgaatcattttcatcattttaccagcactttcaatccctgagtgttttgttccatgaaaacagaaaatattacaacaaaacagagtgttactggcctgcttggtgccttttgatggtagtagaagatttaccccccaatttaaggggctcttcgacttgaggtaacaatgcaggaaacaaacatgagagtagagctagggttctagccctcctagctttgacagtgctggctctgtaacatcaagtcacttccccctccagagtctccatttcctcagctttaaaatgagaaattcagaagagattttcagaatgcctttctagctctttccccttatggttttacacagtagggtgcagcctctctgtaactgaaatactaggaaagacagggatacagctgggccaccagaatcccactggctggcctgcatgcttgggtgcaaagcacataaaggggtatggttgggtctctgagcctctgtggttcctcctgactcagcctctcaaattgtgtctctgcctttgaaaccctgtctctgcccctctttccttcttcctacttctccacctctacatctctgtgtgcttcccagcatgtctcttagcatctctgtcacagccacttctggtctgtatgtatccagcatatccaaatctgtagtctccttttgattcctatatgtctctatggaacctggatgggcatcccagcccagacgttctgctgtccctgcttctcagtccacatgtctccattcttggcttggtctgaaaccatccccccggctgtggtgattttgccatgtccacctgctgttgtatggaagccttatatcccagccttaggccttgctcatttccttctcaatccaatgtccctagtttcatgggggatggggaggggaatagtatttttgccacccagggagggagtatgcccatatttatgtgcagcagagcattacatacccagatggtctggatgctgtgaataggcatgttctgtagtgaaatagacctaaaacggacattagttataacatcaaaaccatgctttgtatgaatgataattggaccagatgtccatcaccaagttgtttaatatgtgtatctctgtaaccaacatcagtcactacaaaaaacttgatcatgtagtaagtaacccacattatttttaggatacctaaaatgaacatgcttttctttttttttttatagctctgattttttaatattccccttttttcctccctaatcattcttttcttttttattattattattacactttaagttttaggatacatgtgcacaacatgcaggtttgttacatatgtatacatgtgccatgttggtgtgctgcacccattaactcgtcatttagcattaggtatatctcctaatgctgtccctcccccctccccccaccccacaacagtccccagagtgtgatgttccccttcctgtgtccatgtgttctcattgttcaattgccacctatgagtgagaacatgcggtgtttggttttttgtccttgcaatagtttgctgagaatgatggtttccagcttcatccatgtccctgcaaaggacatgagctcatcattttttatggatgcatagtattccatggtgtatatgtgccacattttcttaatccagtctatcattgttggacatttgggttggttccaagtctttgctattgtgaatagtgccgcaataaacatacatgtgcatgtgtctttatagcagcatgttttatagtcctttgggtatatacccagtaatgggatggctgggtcaaatggcatttctagctctagatccctgaggaatcacctcaccgacttccacaatggttgaactagtttacagtcccaccaacagtgtaaaagtgttcctatttctccacatcctctccagcacctgttgtttcctgactttttaatgattgccactctaactggtgtgagttggtatctcattgtggttttgatttgcatttctctgatggccagtgatgatgagcattttttcatgtgttttttggctgcataaatgtcttcttttgagaagtgtcaatgaacatgctttcaatcattcactgtatattgactgagagagacagagagaatatttgcacgtgtacctttgtgggtacatgcatgtgcatcaaatcatttaaatctgtaatttgtctcttacatacttccaggaggcattacaaacattcggttgggatctgattagaaaattacttgtgatactttattacaaccattaatttttaactaagtttgtatgtcatggctgataattttcatctttaagagcaaagttgtgtttttcttctagagaaatttctataaactataatttgtggatactataagaccatcgttactttttgcatatttatttgtaatggcttaattttttcatgcaaaagagagcaacaacttagaaaaaaagttgtttttcagattcagtgtacattttaaatgggttgcattcattgatgcagattgagttgcatagtatccctgggctgtgatgatgtagttttgacttagtgttttagaaaattctgctgcaaaattgaatccaggagaatccattgtactctccagcaaaagtaataaatcaactctcacaactcagaatattgctgtcaaattgaaactgaccagaaaagcatttggaatatatttaaatgatacctactatttggccacttggccagtcctttaggaagtatttttggagcagtatgatgaaactgaactaatgtctgacagtttcagcttgagaaaacgaagttccatgtgtaattttgctttcatttcagattaaaattgagcttcccattcacctacatcaaaaacatcatttgcttttcactttttatcatgtaagttgtgaaattaacacaaagggaacaaccaaaaagcaagacacagttgaaactccaggtacgtgttctctttaaatgtctctctctacagttatttgaaatggaactgtccagggtataacctcttttcaccaagctatagaccacttctccccttgaccaaaaaccactgtattagttcattttcatgctgctgataaagacgtaccagagactgggaagaaaaagaagtttaattgaaccttacacttccacatggctgaggaggcctcagaatcatagcaagaggtgaaaggcacttcttggcagcagcaagagaaaaatgaggaagaagcaaaagcagaaacccctgataaacccaccagatctcgtgagacttattcattatcacaagaatagcacaggaaagagcggcccccatgattcaattacctccccctgggtccctcctacaacacctgggaattctgggagatacaattcacattgagatttgggttgggacacagccaaaccatatcaagcacatttctgattttaaaagttcattggtaaaatgcatattatatgttcattttagtatttctaccaaatatcattgtccatatgcttgccaatgtgcttagactactataagcaacataaagtaatattgctattctcaaaaagaaacacatattgcgatacagtatttttgttatttcttttatgtagaattgcccagcaaccagaattttccagttctgctcactgaggaagagggaagtgagcccagagccagggacatctgtgagccagagggaggttgggggctgactagttctaatgagaagataactgatttaacaaacttgaataagcttcagcagtgaagctctcgtcatgggcccattcagcaaggctttacgtaaaccaatgggtagcacccttagcagaaatagaaggccttgtgaacacagcttgtatcacaagcactttacgaacatcagcatgtcctaagattcagatcccagctagtctgtattattcactcattcattcattcagcaaatatttctgcatacaggttgagcatcccaaatccccaagtccaaaatgctccaaaattggaaactttttgagcactgacaagatcttcaagggaaatgcttattggaacatttcatattttggatttttggatttgagatatcaactggtattatgcaaatattctgaaaaaatctgaaaaaatcagaaatttgaaacacttctgttcctaaaaatttcagataagggatactcaaactgtattatgtacaagatattgtagtaggcactttggagaatacagtggagaatcaaacacagatctcatcttcagtgaggatatgatctagtaagggaaatgagtcctgcgtaaacaattataatacaagatagaaagtggtgtttaagaaagtagtgctacgtgaactcagaagagcgagttattcagctggtggagagacgagtggctgagaatcagagaaggcttctaggagatggtgtttgagtgaggccttaaagggttgggtggggtttgataatgcaacaatggcaggaatgtaggggattatggggtgaaggaacagcttgtacagaggcagagtatcaagaggcatggacaggaaaccacaagtagttcactaagcctggagcacagggtgctaggagggggatcataggatgtcaggttgaacaggaggcatcagattttggaaagccttgaataccaggctatagattttattttattctatcaccacagtagaactattggagggttttaaacattagagcagtttttcaggaaaaccaaccaggcagcagtataatgggcaaggcaagtagaagcaggaagaggaagaaaggaacaccagttagagggttatttcaaaagtccaggaaaggaagaggccacactatggcagtagcagcgggggcagagagaaagggaagtgcagaagaagaacatattggacctggaaagtgattggctattagagagatgatttagttagcaatgaagtttcaaaactgggtgattggaaagaaggtattgccaatagcaaaactgtgggtagggatggcaggtttgggacatcagttgagttttaggtgctagtgagacattggagtgatacccagcaggcagcaggactgaatatgagggagttccctttgcaggtagtatggatatgttctttatccccatagaaattgccgttagttcagggtaggggctttgaggattgagaagaaaactggcagaacgatgagaacccatgaccatgtgtacatcctgaaagctaaattactgattcattatccaaatcctagacagaagtggacaagatgctcagcggagcatgaaacagttattccgtgtgccactcatcactttgaactgtgcattctttaagtggcttcccacctttgagccagatggtgtgcttgacattgtacctttatagcttccaagtgctctctatgagttttgaataggggaaacgcttggtcgtgctctgattcatttacagtacaaaaatgttgcctaagcaatcccacagagacagaaagtagactatcggttgccaggggctgggaggagagggaaatggggagtgacttctaagggctatgggatttattttgggggtgatgaaaagttctggaattaagtggtggtcatggagatacaactttgcaaatatactaaagaccactatatgtacactttaaatagatgaattgtgtggtatatctgaatgaggtctcaataaaaatttctatttaaaaatgttgcttaagaacaagaaatagattttcctttcattttcctattttctgggctggaaatcttttctcatttgtcaaatttttagtttaactactttgacagagtcatttctaatggttcttctgctcatgttactttcctctgctttttataaaagaaaaggtctgggtaaagcatttctgtagttgaactagtaaagatgcccgtcaggcacatttcggagtctgagaaagccatttagtctacttagagaagcaatgttttagtctccttttaagaattaaagcatttgccaaattaaacacataaatgaaaacattctaaccagatttgtgttgacttctgtgttcacagtatcacacacacactcacacacagagtcacaaataattttaaagaatcagaaagcagtagctttaaaaaatgttctccagccaataccctctctcatatgccaaaactcagtccagagcaagcttttttacagctgagttataaacacttgaatcccagagtaatttctataatggaaatactgacaccactcaacttgagtaacacagatggctctggcttttttagctagaacatgatgagttttctaattgaaagccaaaaggctcttttggggagaactgttaagaaatgtagagattggggaaaatctcttgatggattcaagtcataaacactatttcctgcctgcattctcctacctacacctacacctcttccttctgtaatcaggacaagtctgcctaactaaatgatttatgcctactgccttgtataaatatggagtgtagccgtgactttgtgaccttaattttccatagttccttaccctagggttgccataagaaattttggaacatgtgattgttatctgaaatagtctcagccgtgagactctgcactcttagtgtaagaatggatgagaactatctgagccttttgaaaataaatccaccaaaaatatttcccaaagcataaagataatggtatcgatgcgcttttaaaggtttaaaatgttttcatataatctcactctaggtttctcaataattcttgtagatggaaaggccatgttgctgttcccatttttatggtcaaagaaatagagtacataacttgttagtggccaggctgggattcagagtcgatccaaacccattgttccttccccagtactcagttgcccagcacctgaactcccacatacagatccctggagacatcaccaccctgccctgccccctagcagtcagccatttgtgtagctgattgcatttgatatttcatttctcacagtttgttattatcttggcagttgggtttgcctgggtacctttgctgaaagatggtagaatcatcacatttgagcagcagctgccagtttccgccaatcttcccccaggctacttgaatctgaatgatgcagaatcaagaagggtaggaaaatactgcatttgttgaagtaatcatgattaaatgtgcaaaaaatagaattctgttggtctcgattgtttagtacaatgttactcaaagtggggtctgagggctggtgcgggtccacaacaaagataaacatggaatgtgcatgtttagaatttatagcagtttgacaaagtaattttatgtctgttgattttaataatttttttagtggggctcagattttgtgcataattttaaaaaattatttaagtaattcattttatcataatttataaaaatagtctgcaaaggattggaaatgtaaaatgatttatgatacatttattctaaaggcagggtattttctccagtaatctcttggtatgaaattaatacattcatttctgaaaaaaatgtttaaatgcataaaggtattatatgttattcatctatccattattatgttatagaatctcaattttctgttcacagcaatgtaacgtggatattaaatgggtagatggtgcaaagcctttgttgaagattaaaagccacttagaatctaccatttacactcaagtaagttgcatcatttgaattttgtcaatttttatacttgagtttgtttgattaaaatagaccacatttgattcctacagccttagagaatatgtgacctgcaagattttctcattagtaataacatctgtccaggtgcagtggctcatgcctgtaatctcagtactttgggaggctaaggcaggaggattgcttgagctcaggagttcaaagctgcagtgaactatgattgcgccactgcactcttgcctggaagacagagtaagaccctgtctcttaaaaaaaaaaaaaaacagtcattctatctcaaatattataattcctctcaaattacatgatcttttaattctcattaactgatttgagcctcacagaactctgaaaggaatgtggaagccatcatctccattttataggtgaggaaactgaggctcaggcaggttaggtgacttacccaaggtcacagagtagtaatcaggggaatcaggtcaaaacacacatttcattattctggttcctgatgtagtccatgctgtctacagaatcagtgtatatgggttccacataggacagttggactcccttgccagtgaagtgccatggtaaatttgggtactgaatgcctgagactattgttctgctaacttcctgctgctatcttttctttatcagttcacatctttattatttatttatctgtatctttttcagttcatacctttattcctgcttatttcattaaaatggagaagcagcccaacttcatagaacacactagtcaaagtcggaatcaaatgaatctttagctagttgggcataaatggtggcctaccccatgtgcttgtgtacatggcagatttacctggttttgctgctttgtatagtggtcaagagctgctgagcctgggcattagaataccggataaataggtctgcaagatacaggaggagggagaggtagagagcttgcatttgaggataatgaatcaaatttcatatggctgtttccatctgtgttccaggatctgcatgtgcacaaattcttccatcattgccagctgattcagtcaggctcgaaagaagttccaggggagctcattaaatatttaaaggtaaatgaacagcagctttctgcaaaacgtttgtttttcatgtctttctgttgccacattttggtgtgaaaaaaaaaagcaaacagacagtttaaaatatttttggctgtatttcctcaagagaatactttctatgatgtatttttccatcatgtggctgtttagaagcagacagcagagtggcaacattaggaagaaaatgtaatagccacaatgcagcatcatatttttgaaactctcatgaaaatgtttatttcaggtccataaattgatttttcaggggctttctcttcctgctgactgcccaataaaggtggaggatgctgtgggggaaagggccaggaggaatggaatcactttgacttggaatgaaatgtgaaattgttcttgtgtccatgggtgatagactaacaaaggggctagctaatgaaagacacatattttatgcatgttggcatattgtatcttaccacatgtatagaggacctaacacttggttttttccctgtgtgctaggactacagtgcatatcataatttgcctgacagtggctctcttcttttaattgttcctttagtaagatagctatagcaagtctgaggaaatattattttaaatgaaacatctttaggatttacctttggacatatgctattacttaatgatatactcaggaaacaaaaatgttcatttctttcagagaggtagtatgagatgagatcaaatatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaagaaaaaagaaaaagattagggcatctgccggatagtaatcgttcatgccacacttatttctttagtgcttcctatgggccaggcatcattctaagcattggaaatttaagtggagaaaacaaataatatccctattgtcaaagagcttacttgttgagacagacaataaacacataagttaataaatatatacgtcatctcatatggtaataactgttataaagaaaaccagcacaatgaaggggagcagggatttacaaggggtccctgttttaaagtggccagagaaaatctctctagtaaaggcacatttgagcagagacctaaaggaaatgagagtgccagccatgtggatttctcggggagagctgggaacagcaagtacaaaggccccgaggagcttggcttggtgtgtttggggaacagcaagaatcccagtgtggctgggacacagagtgataggacattaccttggggaggttgctgggagcttgtcgagtaaggcttcataagccatggcgaggagtttgaatttactccgagtgagataggaatatggagctttggacagaagtgtgacatgatgtgactttggtttttaaagtgtcattctgcttaccatatagaaaacacactgttggaagagtagaagggagacagtcaataagtggtggctatatggctatatgttcttaactatcattaagacgtataataggccaggtgcaatggctcatgcctgtaatcccagcaccttgggaggcccaggcaggcagattgcttgagcccaggagttcgagaccagcctgatcaacatggtgaaacccatctctataaaaaaatacaaaaattagccgggcatagtggcacacacctgtaatctcagctacttaggaggctgaggtgggaggatcgtttgagcctgggaggttgagtctccagtaaactgtgatcatgccactgtactccagcctgggccacagcgagaccctgtctcaaaaaaaaaaaaaaaagaaaaaagtatgataatcatctaacttttaaatcctttcctcaggtaaatatctaggacttcaatatgtatgaatgctttgttaaggtttgttcttcacatgggaaagttttataaaagtttcaatcaagtggaatggaaaagaacatcattttcatatatacgggtattcttaaaatagaaaagttctcgtatttgtttttctgaagatgtggaatttctggtatttatgtgacctacgctctccctctagtggtagtcaatgaaataccatgtgatttcagaaatagccaagctcctctatataaccttagtgctgaaaaggattcttaagactttttttctttctttctttttttgagacagggtctcactctgtcgcccaggctggagtgcagtggcgtaatctcagctcactgcaacctccgcctcctgggttaaagtaattctcctgcctcagcctcccgagtagctgggactacaggcgcccgccaccatgcccagctaattttttttttttttttgtattttttagtagagatggggttttgccatgttggccaggctggtcttgaactcctcacctcaggtgatccgcccacctgggcctcctaaagtgctggcattacaggtgtgagccaccatgcccggccaagacttttttttttttttttttttttaacagatgaggaagctggggcccaagtagaggtgacttgcctgtagacattcaactggttagtagcagaactggggtgagactatgacaagtcccatgttctttctaccacaccttgctatctcttgttcctataaatgacattgtttcaagaattcatttaccatccacttgttgagctcttgttatatatttagtattttcctagctctttgaggcttacagagaagaataatttagggttattgtccataggggaacttacagtctaactgaagagacaggacatacataagttaaatgacagtctgtcaataatacaattaatagttcaaagcaatatatgattaaatgtccagtatgtgatacagggcacaagtgctgagggttcggtgaactgaggaactactgtagactagagggctcctgtctttttttttttggagacagagtctcactctgttgcccaggctggagtgcaatggtatgaactcagctcactgcaacctctgcctcccgggttcaagctattctcctgcctcagcctcccaagtagctgggattacaggcatgcaccaatatgcctggctaatttttgtatttttagtagagacagggtttcaccatgttggccaggctggtctcgaactcctgagttcaagtaatccgcctacctcagcctcccaaagtgctgggattacaggtgtgagctgccgcgcccggcctactttcttattttattcatttattcagtaagtcaccaaatatttattgaccatgtagtatgggccagacattgttctggatgctatgaatcaaatggggaacagtttagacagcataccttttctagttgtggtagagagattataagtgagtgccatgaagaaaagagcaggttaatgagatccaacatgaccaggagtgtattctacatagagttgtcagggaaggcctattgggggaaatagcatttcaagctgaaaggatgagaggaagacaaccttagggggtaaagtcgtgtaaaaggataacagaatatcacagtaggtgtaaacaccttacatcagcatgtttgaaggacagaaaaataaaagaccgtgtagctatagtacagtgtgcattgtgaggggaggatggcaagtgacaggtttggcgggacaggccgggtatgtcgtaggcatggaagcttatgatagctctttgttcgtggtagtttgttttgttttgttttgttttttaacaacagaaagatggcaatgtctaatttgcatttcagaaagaacactctggctgtcatgttgagaataaattacagaggactgctactggtagcagggaatgcccatctctcttttctacctggcactattctatttatcatttaccctttctcatctctgaggccttaccagacattccctacccacttgcacactcagttgcttctttgtgcattttgtatattccatgatcatgctatttactgttgatattgcaattatttagttccatgtgtttatcccctgtacactgtgaactacttgatggtagaaaccatggcctttatttgtttgggtttacttttgtttttggtgtgcttggctattggaagttcatttgtttgccctttgtcgaatgagaaaatgaatggtttcactgaagtggggatttgtacttgccttgaaagagtagccaggatttggctaaaaacgatgaacagacacaaaggcaggaaagtatatgatatattcaagaacagtgaagaaaccagagataccagtttggccttgtagagaacagtgatgattgtttaggctgaaaatgtcagttaggtctgaaataacttggtcttgatactctacgccaggatttctcaatcttcgcactattgacattttgaggtagagttattctttgtccgtgagggtctgtgtgtgcgtcgtaggatatttagcagcattgctggcctctgaccactagatgtcagtatcactccctggttgtgaccaccaaaactgtttccagacattgccaaatctgtcgggaacaaaatggcccctggttgagaaccactgccataggctatggggagacatcgaaaaaatcttggcaggaggtggtctaatgtaacgagtatttgaggaagattaatttagaaatgagagttggatgtatggagagtaaagagaaattgtacagagacctgctaaaaagaaaatgatttatactattttggttattgattagagggtcttgaagacagatagtggcaaaagtcagggaatctgggaaagagaatttatgagttttttaagtacagagacttgatttatccacctctctatttcccctagcactacacattgaattgatatagaaagatgctcagcgaggtttgtttccttttttttttttttttttttttttttttggttagctggttgagtgagtgaatgatgtggagagaagggaagaaagaagaaagaaattgaacaactttcactgtttgtattatttctctgtatatatgatcacgtttcttctttttgatgtttgtaacgcacttatcattggagacacagtgttagcactttgaaggaaatgtattgtgagattcttagactgcaaaagtgcttccgttttgtagtggtgatggtgtagagccaattacatatagaaccactctttattgcattccacttaacttgtcaccagattaactgatgcccacattcccctgcagaacatacagaatgcctgggggttagtagatgcatctccagtatcatctccaaacatctgttcctccccactgccccaggcaattgagtgttggtttaccaggagtcagttgtcaattttctaaaaactgtttatccaaattatacttattagctttagtaaagtgtttaatgttaaataacaaaatctgagtgccaaatagaggtgtggattaagtaattaacaaaaaagccccctatccaatggaaagctcacttttaattgagcttatatgctagtcaatgtatttctcactacttaatttttttgctgtttcacatttgcaaattttatcatatttctgtttgttttcataactaataatgacttaattttagtgtttgcatgccatggagatccaagtcatgatacagtttctacctgtaattcttatgcaactcttccgagttctcacaaatatgacccatgaagatgacgttcctatcaactgcaccatgtgagttttggtgttataatacaaagatgctatttatttgagatctttcttattttttaatggaggtattcattactataaacttccctcttagaactgctgttgcattccataggttttggtatgttgtgttttcattgtcatttgtctcaagatattttaaattttcccttttcttttttgactcaggaacatgtttaatttccacctattttgaattttccacggtttctcctgtgattgatttctagtttcattccattgtggttggaaacaacacttgatatgatttcagtcttcttataattcttagggcttgttgtgtggcctaacatatatggtctattctggagactattctatgtgctcatgaaaagaatggatattctgttgctgttggatggaatgttctgtatatgtctgttaggtctatttggtctaagtgtagttcaagtccaatgtttccttattacttttctgtctggttgatctgtccattgttgaaagtggggtattgaagtcctctatttttctattgcaatatatttctcctttcatgttcgttaatatttgctttatgtatttaagaagataaatatataagttccaattgaactttttccaattatgtaaatgttctgcacttgtgttgttcaatatagcagccaccagccacatgtggctattgagacttcaactggggctggttcagctgaggaacagaatttttttttttttttttttttttgagacagagtttcgctcttgttgcccctgctggagtgcaatgtctcacttcgcctcccgggttcaagcgattcttctgcctcagcttcccgagtagctgggattacaggcgcccaccaccatgcccggttaattttgtatttttagtagagatggggtttcaccatgttggtcgggctggtctcaaactcctgatctcaggcgatccatccgcctcggcctcccagtgctgggattacaggcgtgagccaccgcttcctgcaggaactgaatttttaattgtgtgtaattttaattttaatcaatttaaatagacacaggtgactagggatgcatatttaacagaatgtggccccaagccatcaatttttacttgaaagaataaggaagtattatttttatgtgaaaacaaacaaggatatattgtagagtagaatgcaaaatgcacctgaattttgaaatcaaaacagggtacttaaattgtgggctgagtgctggaagtttctggctttggctttgctgcctctgctgttgccacaacctcttccagcaggcctcacaccacagccacacaccatttgcgggcatcgctgctgttggggatagtgttgttgaaaatggaagaaactttaggccagtggtttccaaaacatggttcccataccagtagcatcaatatcgcctgggaacttagtaaaattgttaatcattgagcttcactccagacctacaaaatcagaaattccgggagaggggctgagcaatctattaaaagggcccaccaggtgcttctgatatatgctaaactttgaggacactgctagtctcttacccccaattatagttcatatcattacacctgccccggctctcccttccttttccccgttgacatgcttttcattgcgtctttattcctttcctttccttctcctttcctttccctttcctttccttttccttttcctttcctttccttttccctttcccttttcttttcctttccttcttttttttttttttttttttttaggtggagtctagctctgttgcccaggctggagtgcagtggtgcaatcttggctcactgcaacctctgcctcctggggttcaagcaattctcctgcctcagcctcccgagtagctgggattacaggcgcccaccaccacacccagctaatttttgtatttttagtagagacagggtttcactgtgttggaaaggctggtctcgaactcctgacctcatgatccacctgccttggccacccaaagtgctgggattacaagcatgagccaccgtgccgggccttcatttttttttttttttttttttgagacagagtctcgctctgttgcccaggctggagtgcagtggcgtgatcttggctcactgcaagctccgcctcctgggttcacgccattctcctgcctcagcctcccgagtagctgggactacaggcccccgccaccgcgcctggctaattttttgtattttttggtagagacggggtttcactgtggtctcaatcttgtgccctcgtgatccacccgccttggcctcccaaagtgctgggattcagccttcattttatctttctattctcttccttttattctcactagaggagatctcaatatttacctaatttgaagtcttttactggatagtagctaccaccatgcttcagacacatacagagatttagaaacagatgtgacatctgggttgtcaaattaaatatccttcttttgaactaggaaatatatttcataaggcccaagcatgttagatgctgaaatctttgttatgcctaaactatcaccattatatctaatgcaatcatctcacttttaattattcaggcagtgttagatgttttgggggctagacatgacgatcttaagaatcaaaatatgttaattcattatagcatgacatgctgactcttgtgaatgtcgtttcagggttctcttacatattgtatcaaagtgccatgaagaaggcttggatagttatctaagatcattcataaaggtttgtggagtaaagtttctttctgagcaatttgttttatgtgacaattttgtcttacagttcatttttttttgtttgtttatttgtagtatagcttccgacctgaaaaaccgagtgctcctcaggcccagctgatacatgaaaccctggctactacgatgatagcaatattgaaacagtctgcagattttttatcaataaacaaattgctaaaggtatgaacacaggacacaacaaggaacaaaagcagccatagacacactttttttgataccctcccgtttcacttctagtctttcatcagtttcacatgtgacccgtcctttctccaccattttgcccatgcatccttttcctgaagttctccacagaaccttcttcaccccaactacccaccccctgccctcatttaaatgtgtaaaagaaagaattttggatcagatagacctgagttagaatcctgtatccatcacaaaatagttttgtgacctggggccaggtatttaacatttctgagcctccaagtcctcatttctaaaatacaagtaaagcatttaacacatcgttcctggcacattgtaggcactcaagaaatgatagctcttattattgtcattatttttattacttcttttattaatggtagaatttcgagtatcttggagtatatctgattggggcttctctctactcttcaaattacatgaggtaggcaaacatctaggctacttaggctgcacgaatgtcacatcaagagcagggttggggtccaagctaagtgcaggtggtaataagattcattgtctatagagcatttaaaagcggtaacaagataaactagaagttagtttgctcttattaccacttgagggcaattagaaacaattttggggataaaatactccccagtgggacaaaggttcccatccttcctttatatattaccagtcaaccctgaagtacaatagtacctttttgctaaaaccatttgcagatattctgtgactttgatagtgacttgggatcacttgaaaatgttagtaaaattcaaagacaagacccatattgatctgtcaaactttgctaagcttcagagatttggtaaccgttaaagattctctttctttttttttcagtactcatggtttttctttgaaataattgcaaagtcaatggccacatacttgttggaagagaataagattaaggtaagtaaattaaggtaaagaataactttcaattggcaaatgataattgtatatataagaataatatttgatggagacaaaaaaagctaatcttactctcagatagccatgccatgcaaatcccattttatatttaaaggctgctagtgcttggctttttcaatgttgcttacaaaacaatggatctattgcataaatctgaggtctcgcagttgatatgttctcaccgtctaatctgcagagacttttccacatagattctttcctataatcatttgccatgtacatctcattacctttgaagctttgcctttgtcttatggcttaaaaatgtctctcgagaagacccatttggttaaatcagacatagcgcttgcccatgcacgtggagtgttacaaacactttatgcactagatatgatcccggaatgtgatgtatacattttgttgtaatttttaattgtttgaaaggtataaaaatattttcttattcataggaatcataaagctaagacttgtgaagtacaaaatatttaccttatacttaattattttttatcagaattttcacagaatatgtttactgaaattgaagtgcatgcatactttgtgtgccaggaaaaaagtagaatgaaaactgcgttgtgtctgtaactcagaagcatgatattccaaagttggggcagaacaacccattcttgctgataacctcagtcaggtagattattagagatccagatagttcctgtaattatatagagtgaagtacatcttgaactagtgatgtcatttttaagttgggagaacaattatacatcagttttaagatatatttatttgtagaatgtgtttgaaagtaaaaatggcaattgatttagaccttttggaagtctgacttttttctgtgcctatttcatttcagcttccccgaggccagagatttcccgagacatatcatcatgtcttacattcactgcttcttgcaataattccccatgtgactattcggtatgcggagattcccgatgagtccagaaatgtgaactatagtttggctagcttcctgaaggtgagttcaaggcagctagaatgtggtaaggaactcctcttcattgataggaagcccaagaaaaaaattaagcactttctagaggctcagctaggtcttcataagactgttggaaaacttaggttgcttacaaacgttggctattgtgaacagtgctgcaacaaacatgggagtgtagatatctctttgatgcactgattttcttccttttgggtatacatctaagagtagaatgttggatcgtatggtagctctattttcagttatttgagaaacctccatagaagacattggcattggcttgtgttctatatggcgattcaaaaatgtgagaggctggccaggcacagtagctcacacctgtaatcccagcactttgggaggccgaggtgggcggatcacatgaggtcaggagttcgagaccaacctggccaacatggtgaaaccccgtctctaccaaaaatacaaaaatcagctgggtgtggtggcaggcacctgtaatcccagctacttgggaggctgaggcaggagaatcccttgaacctgggaggtggaggtttcagtgagccgaaatcacaccactgcactccagcctgggcaatagagtaagactccatctcaaaacaaaacaagaaaagatgtgagaagctaccttagtagtcaaatttaactatatatacaagataaaggtgataacaataataccagaaatacaaacaaatctgttcttgatagtgattgtactaatttacattctcaccaatagggaaggaaggttcccttttctccacatcctcaccaacacttgttattgcctcttttggataaaagctgtatattttagcttacctgatcacaacaaatttgtccccatcccccaatgaaatgacaaataattaaatcagaggacacatacaggtggcctagtcagaagacaagtgttgcttgttgtacacagtgtttttaagcatagtttgaatgcttatttaaatgggagcacatactttctaggttgccaccatccctaccactccttattacagccctgagcctcctcattcatttaaatcgtttctctgaccccgttggcttttgactttgcaacttttggactaaagcaacctgtttggtgatgtaaccacagtgtacatgttgctaatacgtgtaaatgtaaattgttagtgttgatcagtgaggttattttatttgggatataccagaagaaaactatatttatgaaagatggcaaactaccatcattaggttttgttattgtcagtatgtaagtggcagtgagagaatgtaactgttttttctttcttttttcttgctttctttcatttttttttaatttgagacagagtctcgctctgtcacccaggctggagtgcactggtgcgatctcagctcactgcaacctccgcctcttgggttcaactgattctcatgtctcagcctcccaagtagctgggattacaggcatgcatcaccatgcccagtatttttagtagagacaggggtttgccatgttggcctggctggtcttgaactcctgacttcaagtgatctgcccctcttggcctgaatgtaactgtgataaagtgggtaacaacaatatttgatgtgtggcagagacaagcgtgggttgcaaatgcacctagtttttacttgcctctttccattctccctctcttcatttctcaaagctcttcattactctcaaaactcttcatattaagaaccttgtgggcagcaattcatccaaggagttttagtttctaacatatcctcattgttaattaaaaattcacaactaggtttcacacatcttgagtatgattttctgacataagacttctctttgccagaattaaaataaagttttaaccctattacactagccttttttgtgtattaaaaaagccaacatccacatatctttttaaaataaactacgaattagattatctgaaatgtagaatattagcttcttccatggagtttaaagttgaagtttactatgtaaagggaatagaacatttttggtttagtagcagtatttacttaattcaagtcagcaaacattggcttgacttctgtgtggcaattcaaagatgtgagaggccgtgttagtagtcaaatttgaatatatatacaagataaaggtgataacagtaataccagaaatacagacaaaatactatagaaaaactagaaagggagagagagattatgaccaggcagcatgaaacaagtaacatagtgcagagttccccaagacaagagttgagcatgttgcagttagagggtccctgaacaaagatgaaatatgcatgttcaaaaattgttcagggacgagtgaaaagtcgtgtgatgagtttaggatgtatggagaaagagctggaaaggccatctggtgccaataatgaaaggccttgaatgtcaggttaaggaatttggactttgattcatatgcaatggagtaacaccaaatacttgggaggatacttttcttgctggtatgatagatgaagtgaggaagagactcgagtcagggcaaccgattagaaaaccaatcatccgcgtggcacaatccacttatcttttaggctcagctcttccctggcctttccatgcagtgttgatcaccccttctgttgttcacctgtcttttacatagctctgtggcactgttattgtgcactatcttttcattatttgtttgtcttcactattagacatgattatggaccatgccttattccactttgtatttctctagaatgtagtacattgtctcaaacatagtagatcctctaaatgtttgttggatgctggaataaataaatatgagcctcactcagtaatccagatgagaggtgatgagggtcttaccctgggcagtggcagcagaagtataaaggagagtatgagatgcaagatgcaggtagctggttaatcaaatattgaattcttcggatttcacagaaatattctaggcactatgaaggatataaaggaaaagatcattcttattgtccaatctaggtgagacgacaggaaaacagtcagtaaaatacaagctaatactgaaataaagtgtttaaaaggatccatggaccaatgtagttaaggaagatgggatttcatgagaaccttaaagaatgaataagaccagatagaagtagcgaaagaattgctaggtgtggcataagccaaagacttagaggtgggaatacacagtgcatctcgaggggataataagtgaatgatggctgagcatgctggtgcccgccttagtctcagctacttgggagacaggcaggaggattgtttaaggctgtagtgcgctatgactgtgctaccacactccagcctgagtgacagagcaagactctgcctgtctctctctctctctctttttttctgttttgagacagagtcaaagaaagtcaatgagatctattggcaaatgaagctggacaagtaagttgggaaaagactatgagtgttcttgaatggcaagctaaggaatttgaaattgtattagagacaatagggaactattggaagctttggggcaggaaaatgacaccattgggctaggacttagaggttaatctggaagcagatggatagagacatgagagacatgaagactgaggaggttaactgcagtttttcagttgcaaggtagtgagagccttaactaggacaatgacagtgggcaaatataaataacttggggctgtcacagagaagggaggttttatgctttgacttcactgaacacaaaaactcttttggtctgaattattaatatttacataggcaagcctcactttcatcagctaacagactaccttacacttccctttggaagtgggagttgaccaaaatgaggtcaactcgcttgggctttgagagttgaccaaaatgaggaagtgtagctgaatagattacagatatgtatgtgtgtctgtgtatgtatgtgtgtgtatgtatagataaatgtatatttgtgtgtgtggctatatatacatcttgttctgaaaactgtataattgaggcccttcagtcccaattccagtgatgccacttgccctttatctttttctttaaggtcacctgaagctcagaaagttatctataaaaataaaaatgtctttctttttgtgtggaaccaattttgaatttttaaaactttacatttttaaaatttagacttttagaattatgtaattaacccttagttttgttttggtttctatagcgctgtttgacactaatggatagaggatttattttcaatttaataaatgactatatatctggattcagccccaaagatcctaaggtaagttataaggacatgattgtagtggatgtcagacatctgagcataagaccaaagtgacatttattctcttctaggggattaggaactgttgtttttatttaggtagttggactatagacatacgtaaaagcaaggaatactggactgtgttttggggtccccaggaccccccatgtgttcaatagctcattttaaggattcacagactcaacatatagttgtattgatggctgagattcatgagcgtgacataatgaggatactcagctgaatcgggaaaggaaaagacatcaaatggggtgggtagcaatccacatgcagcctttttgagctctttccctcctgtgaagggtctcacagagcacagcctccttctagcagtgaaaatgcacttgtaagtgtgcaatatttctgttcaaggaagcctgtttaaaactcagagttgagagtttttattgggggctgattatgtgttggaggctggtcaaaattccagactctcagaaaggaaagcaaagcaggtgttcactataaatcacaatgtttgtacaaatagtctaagcaggctgacacagaaggtgcaacttaacatgtagggaacatttcaaaatttcattttttagatgccagccaacaagcaggccttttaaaggatagcagtcttggacctgctatgttaactctttcctgcacaggtcgcatctcaaggtatgcttagaatactaagcacttccgttgtgaaaaataatgcgctgtattaaattcttaaaatagcaaatgcctactaaatatgagctaatgtatcatttctttccatttaggttctggctgaatacaagtttgaatttctgcaaacaatttgcaatcacgaacattacattcctctgaacttgccaatggcatttgcaaaacctaaactgcagcgggttcaaggcatgtatttgcattttccatcatttgagtttgtttttttccatgttttgctagcgctagtgtagtataatgttttctagttgaaccagtcaacttgaaggtaatttcagaattgttactatctgaagtccattaatgtttttctgcatttccttcataatatcagtaataatgttcatagtgtgaagaaatcaggtgtgttaatagattgctgcttaaacacagatgtcagatactagtgaaattactttctgtagtagtgtttgggatcttgtatgagactaaattaagaaaaagacatataaatgcatttctcctcaaagcatcaaaaaatgtaaaggtagagtaaaatggtaacatgtttgtgctaaatttatgaaatgccttcagttatctccattgctagttttattgaatgctttgttgtatagcactattcttatgttactatgttttttatttgtcccttttcttttcatatattaattagattttttttcatttgcggtggaccgtttgacttcagtaggtaggtttaactcggttcactctaaattagcttgctgttttagaaaacaattgatttgatgaattgctaagatggatgggggctttgtttgcttttcaaattctccctagccaaaatgaggctttagttaaagtacccagaaaatctaggaggcagtgtgtttgtttagttttaaaataaaactgagtgttgctagagaaatcaactttaaaacattttccctcaaaacacaagttcctgctgcaagccagcatagaggccatggatggggaactggaagttacttgttttttttttgtttttgtttttgttttttttttgtgtgtgtctcctctctcaggcttgcctctctcagatgctgtttagtgacaccttggccacaattttgcaggtgtagatgaaaccacctgattggatttattcaaatcaccaaaataacaaattgattaccatttgtaaaatctactcagataaagccacctttgttagtcagtcctggcccttgtgcatagaaggtgatagggattcacaaaagagcaagaccaatgcaggaagaaaataatctgccttggtctgtatagaagtatctgctgagtggtggttttagtgatggaattatagccagtgaaaatggagaaaaaaatatttttaaaccatagcactcctattcagctacccccttattcgattctgaacatgtatagctcacataattcacccaatatttatttataactatgaggaagtcaggaaaaagaagaggtggacagataatcaggatttaggattaaattggactactcgcagcatttattaagtcccaactgaatataaagcattgtattaagtgctgaacaggccaaaagaaaaatagaaaacataatccttcggcttcatggcctatctaattaaatagcacgggagaggaaataaagatagtagaaatctaccacagaaattactaaacttggctgggcgcgatggctaacgtctgtaatcccagcactttgggaggccgaggcgggtggattccaaggtcaggagttagagaccagcgtggccaatatggtgaaatcccgtctctactaaaaatacaaaaaaattagccgggcatggtggcacatgcctgtaatcccaactactcaggaggctgaggcagcagaattgcttgaacccgggaggcagaggttgcagtgagccgagattgcgccactgcactccagcctgggtgacagagcgagactctgtctcaaaaaaaaaaaaattactaaacctgatcacaatcccctataagtacttataaagcaagtcccaaccatgatattaacatctgggatttaaaatagactgaggatctagcctgggcacagtggcttatgccttaatcccagcacttcgggaggccaaggcaggcagatcacctgagctcgggagttcgagaccatcctggccaacatggtgaaaccccgtccctactaaaaatacaaaaagaattagttgggcatggtggtgcacgtctatagtcatagctacttcagaggctgaggcaggagaactgcttgaaccctggaggcagaggttgcagtgagctgagattgtgccactgagctccagcctgggcaacagagtgagactccatctcaaataaataaataaataaaatagactgaggatcttaaaggaagggaaagacttagttcgaagtgattattttctgatataaaatatttgtttttgagtgatgatggattggaatgaaatgagactgttttccttattgttcttatgtcccatgtatattttcagcccaatatataatatttactaaaacagtcaatactgtcagactattcagttgtttagtttgtcttttcccactttataagtataaatggataagtaaatcaagtattattacatagaatttttcaaatttatagttgtgacaaaatctcttcagctataaagaaatctgttaaaacgttgcaaaatatataattattttattgtagtttctatcctaagatttctatgagtttaaaagaatctaggggaaaaaaaagaattagggactttctttctgactgaaatgatcattaaagctatcgtttagcccaaaatatgagtgctcctgtcttgtaaattttgcatgcttattctagatgataaaagaattgctcagaatcattaataataaaaattatagctcttgctagcatgatcacatattattaaataatacagtattttaattataatcatgttttgaatattttcataaatgggttttaaatttcattgtactgcagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaaggtaaggatatccatgcagtcatcagtatcacactggtagagttctactatgattttttatagaagatgaagtttttgtagcaaggagcattatataagcattgaggaaaatttatttttgcttcaaatcataagttgttttttttttgagacagagtttcactctgccacccaggctggagtgcagtggcatgatctcggctcactgcaacctctgcctcccaggttcaagcgattcttgtgcctcagcctcccgagttgctgggactacaggcgagtgccaccacgcctggctaatttttgtattttttagtagagatggggtttcaccatattgtccagactggtctcgaactcctggcctcaagtgatccacccactgtggtctcccaaactgctggaattacaggcatgagccactgtacctggcctcaaaacattaggtttttaaaaataccatttgggaccgggagcagtggctcacacctgtaatcccagcactttgggaggctgaggtgggtggatcgcttgaggccaggagtttgagaccagcctgggcaacatggtgaaacctcatctctactaaaaatacaaaaattagccgggcgtggtggcacacacctgtagtcttagttactcgggaggctgaggcaggagaatcacttgaactggggaggcaggaggtggaggctgcagtgagctgagatcatgccactgcactccagcctgggcgacagagtgaaactctgtctcaaaaaaaaaaaaaaaaaatatatatatatatatagtttagttaactgttaaagaaatacactgttttctcaactcatacttaaagaataacataactgcttcatgattaagaatttttaaaaaatttattctgtgaaacatatgctttaatatatctttaaatatatatcatatgtaaaatatgtaataagtttttcttcttactgaaaaaaatgttaatgtgatggtgttactataaatagctgtgggtgtggctataaattttacatacgttacactgttgtctatgagtaacggtcacagctacagtttctatttactgcactaattttgttttctttctttttttttttttgagatggagtctcgctctgccacccaggctggagtgcagtggtgcgatctcggctcactgcaacctctgcctccctggttcaagcaattctcctgcctcagcctcccaagtagctgggactacaggcacacaccgtcatgcccagctaatttttgtatttttagtagagatggggtttcactatattggccaggatggtcctcatttcctgacctcatgatccgcccccctcagtctcccaaagtgctgggattacaggcgtgagccaccatgcccggcctatttactgtacttttaacatatatattgaaatcttactgacattaaatcctgttggcttgaaaaagtagagtgcaaactgtatggatttagaagactctaatttacttccacggtatcataaatcactctaggaaacataatattgtttcataataaataatttatccttttctttttacattccaatataaataaaattatgatgtcatttatcatcggtcattttggaaggctgacttggagcttttattctttttctacggtattcccatttgtcctttttaaacagaaaatgcctgccagtgacatctgctcacattcctttaattacagtgattttcatacatgtaaatcttgctagttttcttcatgtgattgtatcctaaagtagatttaactcctttgctttaagatgtaatttattgcttactgcagtttgctttgtttttgacacattataacatacctccacttagtgtagttggctcagttatgtgccattttcactttttgtgaatgttgatattgacttcacacaaattaactggtataatatatccaaataaaaagatatcttaaaagtcctccagtccaatcaagcttggtcaagcctttaaaaatgcattatcgctgggttctggctaactacttgcttatgcctgtaagtggggaaaaggatcttatgccacgtggaggaaaatgtctttagccatgattttaaatgattcactggaaaagtacaaaatgaacttcccctctctgaagcaaaaagttgtatatttctccactgccttttcacatgaaagagaaagaaaattggattttgccagtgggattctcaccacctagaggcagaattaaatattttatatcacaaatttggacacttttaacttactttttaaattcttagagcagtgtgtgtacacacgcaggtattgttacctgtaaataagttagacactctttgagtgtttgaggttttaaactacaggaaagattgaaatgccaagccttattactctttcaatgacttctgaagctctttcctctttgttcagaggcttcatacaggcattaaatgacgatagagttttctccataagaagtttgtttacttcgtgggcttggttaaccaaagtttcaattctagagtattggatgaggatataaaaggtcctttgtctgttttgtgcagtttccaggcagcctgtgtaagagttcatttatcaaatacatccaagtagagcatgtttcctattaatgatgacaccaaggtgagggattggagggagccttaagccctcatattttccatcagttctctaaagggaccccaaagtaataaaccaaaaaaagaaaagaatgtttcctatgaaaagcctgctttgagactcaactccctaatcatccccaccctttccagccaattgccactcctaagcccctgctcttaggaaattctggagatattgctggtccctgttatgtgttactcataaactatttagcaatatctctctcttttttttttgtgacggagtctcgctgtgtagcccagactggagtacagtggcacaatctcagctcgctgcagcctccgcctcccgggttcaagcagttctcctgcctcagcctcccgagtagctgggattacaggcacgcactgctatgcctggctaattttttgtatttttagcagagatgggatttcaccatgatggccaggatggtcttgatctcctgacctcgtgatctgcctgccttggcctcccaaagtgctgggattacaagtgcgagacaccgtgcccagccagcaatgtctcttgttataattaccatgagacatttttccttttcagaacaagaatgttcaatatctaacatttaccctggggcctgtatagttcttgtacccactacaagtaatgttcatacctaagagaactgcagattctacttctagttcggctgtgggcaaatcctttttccttttttgaaaaagtaatccacgtgcatggtgaaaaacaaaaatcaaaatgcctgtctcccattccttacctccacttaccaattcatctttccagaagcaactactcttgtgagtttatttatacttctattttatataagcacaagcctatatgacatatatgtataaaatataacagaaaccattatacatttttcttttttcacttaacaatacagcctgaaggttagatctaccgcattttaaaaagtagctgcatagtattctatcatatggatatactttattttatttatctaactagtcttctattaatagatacttaggttatattctctgttgtgcaggcaaaatttttaacatatttggcaatgactgtatgttttcctgtgttcctgcttccctgagagaattgtaatttctcttcccctagagatcactcattatcagaactaaaatggactcctatttagaagccataatattaataatagcagctaaaatttattgaggactcactatatgccgaacactattttaaatacctcacattaattgatatcattattattacccccattttaccaaagagaaaactgtagttaagtgacttgattgtaatcaagtagctagtaatgggagagctgggttttgcgcatgtctctaactgcaaaatctgtgctgtcagccactagctatactgccttttaaatctcaacttgggacattgaaaaattagagaaccaccagaaaaagggtaatcactaagtgaaaaatcttgacaccaaagtcatggaacaaaggaaagtaatgagagttaaaaggccgggagcggtggctcacgcctgtaatcccagcactttgagaggctgaggagggtggatcacctaaggttgggagttcgagaccagcctggccaacatagtaaaacgctgtttctactaaaaagggacaaaaattagccaggcgtggtggtggatacctataatcccagctacttgggagactgaggcaggagaatctctcgaacccaggaggcagagattgcagtgagctgagattgtgcctctgcactccaacctgggtgacagagtaagactcagtctcaaaaaaaaaagaatgagttaagatgattcatggtaactgtattcacatatttaaagggttgccatgcaaaagtagaaatagacttattctttgtagctccaaagggcagagctatacctaggaggtagaacttaggaggagtgtatttcagataaaggaccttcctaatagaacccatgaaacggcttgagttttaaagaagtttaaaaaactatttgtcaaggatacatgtaagggccattcattcctgccttcagcaggaagttggactaggttagtggttctgaaacatttatgcacatcagcatcatctggaccagtccagacctggtaaatcagaatcttctggtggtagagactattactgacggggtactatgttggaagaaagtctgttaagaagggaagggtttttgaaattcacaaatgaagtgcaaatggccaattaacacgtgacaaattgttcaacctcaatagtaaatgcaaactaaaacaatagtaagagaccagtaatcttctacattctacatattgaccattttgccctagagggccttatctaattctccagaaaaacctcctaaagtcatgaaagatagagggcaatgcttgtgctaccacagccactattttctctgatttgagtgtatatacatatctggcgaggaatgtctataagctgaggaaagaaataaatttgtataagaggtaccacattaattaagagccctggtggccagttttatttacatatttacaaatatatcaatctcccaagtcttaaaattgacttaggggaccaagttcatattattgtaattgtagctttaatggaagcaaaaaatgtttcctgaatgaatacagtaacttaccattttttcacttcttccacttactcattcattccttcagctaatatgtattgaccatctgctatgtgcccaggcattggggatgaagcagtgaacaagacagacactgtccctgctctcatgaagctcaacgctcactggagctgaaaaacaggaataatatcatctgctttataggccaacttctattttttacaaaaaccttttacttcatgtcattatgtttgagggatgtaatttgagtctgtatcatggataaatccaaaggccaacaaagttctgtggtaattagttttcagactataagtataaagagattcatgcttcagtaatttgttatggatgttagcctactttttagtctttaaattgatatatgaagccaactccatttatttgtaatatatacatattatatacgtattaagctttcaataattatttttcagaaccaacaagccaaaatagcacaattgtacctcccctttgttggactacttttggaaaatatacagcgattagcaggtcgagataccttgtattcttgtgcagccatgcctaattctgtaagtagtaatgtgtttctgttggagttttatcctattttattgaatgcatttggaattggggtcatatgctatatgatctcaaccttaagagttcacttttttttttttttttttttttgagccagagtctcgctctatcacccaggctggagtgtagtggcacaatcatagttcactgtagtctcaaactcctgtgctcaagtgatcctcctgctttggcctcccgagtggctgggactacaggcatacgccaccatgcccagctaatgtttttcatttttagcagagacagggtctcactgtgcagcccaggctgatctcaaactcctgagctcaaggaatcctcccctctcagccccgtgaagtgctgggattacaggcatgagccaccgtgcccagccaagagttcagtttttactccatgtacactgtttttcctaatacagtgctttgcaaactttaatctgcatatgaatcacctggggaatttgttaaaacaggtttttttttttttgagacagagtctcgctctgtcgcccaggctggagtgcagtggcgtgatctcggctcactgcaacctccgcctcctgggttcaagggattctcctgcctcagcctcctgaatagctgggactacaggtgcccgccaccatgcctggctaatttttttgtatatttagtagagacggtgtttcaccatgttagccaggctggtctggaacatctgacctcaggtgatctacccaccacggcccccaaagtgctaggattacaggcgtgaggcaccacacctagccaacagattttaattcaatagacctggggtgggacttgagagcatgcatttctaacaagcttttggctgcttctggtccaaagattgcactttggaaaacaaattccaagagaacaccacaaatcctttgaacgctgtgttttcgttcttaacattttctgttgttgtatggcttcatacatttattcaacttaaactgaacaaaagattctctacttccaagatattaggcactggggactaaactgtattcctttgcttctcctttcccttagtagtctccttcagcacttcttggtgagactcttttagtttatcacaattggtctgtgctttttttgctccccttagaattttaagaattagaaggaactttggaggtgatcagtctcctatttggcaaaacaaccttttgccattgtaataatttaaacattccttctcacattagacctaaaaggttttctatccactggtcttacttttgtcttctagagacacatgaaacacatctgttcccacctccaaatgtaccctttccacttgtgccttctaaatttttctccaagccaccaaatatctccactaatctgtcattccaaatcctttacttttttttttttttttttgagacagagtctaagtctgtcacccaggctaaagtgcagtggcatgatctcagctcactgcaatctctgcctcctgggttcaagtgattctcctgcctcagcctcctgagtagctgggactacaggcatgcgccaccacgcccggctaattttttttgtacttttagtagagacggggggtttcaccatgttggccaagctggtcttgaaatcctgacctcaagtgatctgcctgcctcagcctcccaaagtgctggaattataggcatgagccactgtgcccggtccccaaaaccctttgctttcgtggtcaccccttttccaaatatgcttcagtttaccagtaaccctattaaaatacaatgtccaaattatacactttatagtctgcccagtggactgttaacttctgcccccatccatgttctgtatggcccaagatcacctttgcactttggctggccacgtaatattgttgggtagcaggttaaactgtgtcatttacagcttcctctgcaaattccccctatgaaatgctacagccaatttgtcatgcctgtcctgtgttcctgaggacgttgcttttaagcttttctagtggcttgcttccctgtgactcccagtcatgtcaactggctgaatgtggatactacacctacctgagtgtcaggctggtctcactttacaaatacagtatctcatgcttatgctccctccacatagatttgacagcattatttggaaatatttcacttctctgtattctttgcagctcaagtttccctagggcttctggtcacacaccttcttctagcattgccctggttctaaggaggagaactgaatcatgttaagactttaccaggctgggcgccgtggcacatgcctgtaatcccagcacttggggaggccaaggcaggaggatcacttgagtccaggagtttgagaccaacctaggcaacatgggaaaaccccatctctaaaaaaatgaaaaattagctgggtgtggtggtgtatacctgtagtcctggctaatctggaggctgaagtgagagggtcacttgagcccaggaggttgaggctacagtgagctatgatcatgccaccgcactctagcctggactacacagcaagaccctgtctcagaaaacgaaaacaaaaaagactgtaccagttgcagctgtaccagttgcagctatctagaattatgtcacttggctagaggtcatggttacaacagtatgctagtagctttttttttttaaaaaagagtcacctaaatactaattactagtatctgatttagactttcacagtgagctttgtttaaaatcaatgtaacattttattctgttaattcagatttcttatcctatatacgaatttgtttaaatgacacaggtatcatattctgttacaggcatccagagatgagtttccatgtggctttacttcacctgccaatagagggagtctgagcactgacaaagacaccggtaattaaaccttttggagatgatacattgcgtgggtgtttagacatgtaccctctacttctcagtatttttgatatatttcataataaagaccatacatagcttgatctctactaaagtttaattaaaatctgacttatacttgcagtcaaatttatttgcctaggtttccttgtctaagcttatttagaacatagcttggcatactgagaaaatagaggataatgagaaaaatactggtttccactcttcttatctgtcaccagttttaagccagatactcccatctatgggctcaagtttccttgtctataaaattgtcttttaaattgtgtggctttattttacggcttccaaggaatttcttgtcattttgtacatgctaaagtgttttgaaaggtgaaaagttgcttcacttttacatggtttcttatggtgttttgatataataaacttcacattttagatgtccaagatctattccctacattaatgtctctacttaaattagttccgtactttttaaatatttctgacagttccccctcttgccaacaagggcttgacttttttttttccccagcttatgggtcttttcaaaatggacatggaattaagagagaagattcaagaggttccctcatcccagaaggagcaacaggatttccagatcagggcaacactggtgaaaatgtaagaacttaaatatataggatgaccctagtgacacattagcctgcaacaatttttttatagtataaatatgagcatctgtactcacctgtagtccatcctggctctgcgaaaagcatcccataattcttagatattttagcagtatcttcctatagtggcagctgctacttcaatgtcttaaactatttatagagaataaggcattcatcctcaagagttctaactctgaatatctcctttaaccctagcacgctattttagtgaggagaaattcaagtttaaaatatctaatgtgccttgttatttaaaacgaagcacatcctggcaggattaatgcagtctttcattcttttgtaatagagtaatgatattaatttgggaggaaaaaatataggtcccaaaattgacaatcttagggtcccagcatcacttaatcagaatatatcctcccaactcttctatcaagtcgtttcacgcctaccattaaagtttgagatgtgactgccttaaggcagaaagacctcattttagacgagtaaagttttgccatgttgttatgtaaaatcattgaatcgtataaaattatattagaagggactataagaacaataaattccaactctcaatttacaaatgaaaattgggattatgacttagaacaaccagctatggcaggaccatactcgaacccagattttctaatatgagcactttgtctcctatatcatggtgctcttagtgtacatcagcatcacctggagggcttaaaaaatagatgtctgggcctcaccccagggtgagattcagtaagtctggaatagggcctgctaacatgtatttctaagttcccaggtgatgttgatgctgctggttgggtattgttacccttgagaaccagtggactatacttccactggttccttgagcctttgggtaaacagtaatttattcacaaatgtttctcttttacaccatttagaaattgtgacaacaggtactgtcatagctaaggcaaataaaggtcagagaggttgaatgacttgctagtagtcacatagtagctaggcaagcaatcagaacctaggtctgtttgctccaagtaaaagttcttccttagtaaattccaccctagtcaatggtgcatccccagtttagctcaactgaaagtattagtttttaaattttttagattattgttattctattcatataaatccccaaataagtcagatcttgtcatgcttaatttctgatattttttaaaaagtcattaaataataggaacacatcagtactttgtagaggtactaattttgaagtattattgggtactcctaagtgtaattatcgtaatataattagcccattttttaatttatttatagtttttagaaatagggtcttgctctgtcacccaggctggagtgcagtgacacgatcagtgctcactgcagccttgaactcctgggctcaagcagtcttcctgcctcagcctcctgagtagctaggactacaggcatgcaccatcacacccagctaaattttttttttttttttttttgtagagacaggttttgctatattgcccaggctggtattaaactcctggcctcaagtgatcctcccacctgagcgtcccaaaacgctgggtctacaggtgtgggctactgcgcctggttttattagcccttaagatagattttctaatgtatgatttggaggttggattttaataaactctaaggaaagattcaaatgaaaaagtttaagatgtttcttatgctttcactccatgtaaaagctatctttccttaaatagccatgattattttaaaattttaccactaaaacacatggcatatgagaatgaaacacagtattcatggctatatctttgtgaagactccaaggtaatttctagtgatattactagctattactaggaaagaaagattcagcccattcaccttcaagttgtgatataaaatttagatttatgtttagaattttcccaaacagatctaatgataaaaaaagagttactgagttaaaggctgtggaaaattgtactgatactatttcacgaacatcctgtccttacagacccgacagagttctacaaggagtagtgtatcccagtataaccgcctggatcagtatgaaatcagaagcctcctgatgtgctacctgtatatagtaaaaatgatttcagaaggtgagttaccatcatattaagcatggactgtactagacatacaccctcacaggttcacaaattcatgcaacaatatttgatcatcatctggaggcagagcacatgcacattataaacagttatttggagactctgactttaaaatgtttcttaaattgaacttcaaaataggttcatgtcagtcacacaagttcgagtctttgaaataattttaacataattttgcaaatgaatttctaaaatgaggcaatggttttagaagtgctaaacattttgttttcatgcagagcatttaattcattaaatgaccaatgtaactgaaaggaaataataaccaccagaattcatatttaatacttcagcttttatttaacccaggatttgacaaataagaaacaaaaagacaggaagagttcttgaagggtagggaatgtcatcattatctttgcagcaacactgtatgatattgtctggtatcgcgttctttgtcgggctctgttttttctccttggtatagagccgtatttactagtgtcaccagttcctctttacactatatgatggaatacaaccgaaggactttcataaactgcatgtcctcgggaagtaaaagcaggttatttccaaataccacatttacttagacagttccctcccttctcttccttttcgcaatacttttgcttaaaaaaaaaaaatgcaaaaatggaaaacataaaagcacctgggatcatcatagtgattgctatcttttactcattttctatttttttatttttagtaattatttcgttttaaatattttataataatgcaggatgtaaagacataaaataagttgatatctaagtagctatagaaacattaaaataaatagctagatatgagtaaattctaaagttcattaataaaataaaaataactggaatattcaagttctaggaatgtacgatttagcataaatatcaaacattatgttgtggaatctggaaattgctaacatttatggagtttcttcttaaggcaatgaaaatgttctaaaactgtggtgaaggtttccttagtctttgaataaactataaactattgtaatattgtgggctatttatgtgggcatttttatgataaatgaatctctcagtaaatgtttttttttaaaaagaggcccaatctttatctgttctccactcccattgccacttgactagccttaaaaaaaataggtccaagagatacattagaaaaaaagcagaagtgaacaaaaaagcggttgaataccaccacagcccaaagaatgagggaaagagagagaaggtaggaggaggggaaaagctgcattgctgactagttctctcccctcctccactgtaggtctcacacacacatacacacacatatacatcacattctatactaaccagagacaagtctctggttgttatttttaatgtcatgggtaaaaccatgactgtttttgttttgaagatggagtctcactctgtcgcctaggctggagtgcagtggcaggatctcagctcactgcaacctccacctcccaggttcaagtgattctcctgtttcagcctcccgagtagctgggactacaggcgcccgccaccacgcccggctaatttgtttatttttagtagagatggggtttcacggtgttagccaggatggtctcgatctcctgacctcgtgatccgcccacctcggcctcccaaagtgctgggattacaggcgtgagccaccacacccggcccatgactgttttatttcttgtgaacttgatagttcctcttattcttgcaaatgttgaccatgcttgctcagtggcagtactctgtgccgaatattcagtctttgttaattaggttttgtagtcttctgctcttgctttttgattttaaaaagcacattttcaataactagtatacagtctatgtcacatctgtttatcttttatatgtataaagtcatgctgtatatctgtaaagtcatattcattttgttctaagaaatgtcttctagatccttctcaatggatgtattctaattactttgtcttgtccggtaaatattgttttagttactctatatgcatttaaatatttatctctttcaagtccacaatcttgaggtcctctcttggctttcttttttattgagtcataaacagtagcaactttaatgtcaatgaaaagatgttctatctctacacttttatatggattctggagaataaatttcattctctacttatagctgcattttattaattgacaaaaatttgctatttcaaagtcttagattcatttgccaaacattttcaggccttactgcttagtttattatatcgtgagaaaaggaataagagtcaggagttaccagttacgaagtctgaattgacaagaagactgttctgttggaaaagtaaaacattgttgcttccttaagagagaaggtggtggggggcggtgggggggggggtgaggggggtgggggggatggggaagctacttcctctttctttgtgactgtgtcttcacttttctctttagcccagactccaaaaagacactctcagtatcacattgaggcttatcggcaccataccctgcacttgtagattcattaatattctccgaagcagactgttcattggaaggtatctggttagagctatctctcactgcaaatttggtgttagaaggaatagcaaccactgctcttctttttgtactagattttaaagtagagtctaaaggcaagacattcaaagggattattttcttttcctttgcaagagggctatatgaggttatagaataatcctctaaagtttccagtaaactttcagatacatgagttgggtattctcctggggagatagcggaagggttccatgatgtgccaatctgagtttctttttgcggggagacctttgtttcaagtgtcccttttggctggccaatcttgtcttcatgaagattgaaaaaatcttgaaattcatacctcttttgaggactaagtgaagttgttaaaagagaacttgccagtggcttctggctggcagggtcttctatgttaggcttagtgtcattagaggaacttttcgcaaaagaggtctctggcacttcaaagaggccttgactaaaagatggagctggaaactctgaactttgttgcagttcctttgtgctcgtaggtttcatctgcttactttgtgactggcttatcgatttgataggcacatgcctctgccttccttgtgcaggctccctgactgaaaaatctgacatagtcatttgactaccagaaacgaagtcatcactaccagaagtctgaaattgttgttgcctcattattattttagaaagccttttattttcttctcgtaatttatttgtttctttagtgagttccgcaataaagaaaagattttgttgttggatttcataatagtctttctctagcgcaagcctgtatgtttctgtcattgaacagcagtcacaggtttttgcctttaactgatctttcaagtcattaatggtgctctgcaggactctctgctgtttagtcaactctttaattttggctgtggagcccgtccgcctcccgtctgacaatcgctgtttcctcagacttgttaattttgcctgtagacgccgcagctctttatcatggagctcttttagcgccagccatgtttttttaaaattgtcagattccaaatcacatacactaagccgtgatgattctcttcctgaagatttcttacaacctctcctccctcctacaccctcgttccctgcctgcatcatgtttcacagatttggaaatgggagggatggcctcgtcgctcaacaacagtgccgttaagaaaatggcggacttgcagtggattggagctagttcgctgtgagggcgagcacttttacccctttcacagaccttctccgaagctaccttaggacatggggcgagggagatgggtgctcaccgttggacgcaaagtcccaggttttcgctggagaggaggcaccaacttttcggctagaagagctaacccacaggagagggaggccagcaccctcaggcagtggcgcagcaagctgccctttgaccggaggccggaaacgcagggacttctgggggggaacccaagcttctgtgagtagacacccagtggcagataggcgaaagcggaagtcactgctagcttgatatatatttttttaatttaattttttttagatggagtctcactctgttgagcccaggctggagagcagtggcgcgatctcagctcactgcaacctccgcctcccgggttcaagcaattctcctgcctcagcctcctgagtaactgggattacaggcgcgccaccacgcccaactaatttttgtatttttagtagagacagggtttcacgatgttggtcaggctggtctcgaattcctgacttcagatccacccgcctcggcctccgaaagtgctgggattacaggcgtgacccactgggcctggcctaatttttaaaacaagtcaaattttgagtctattttcagttttattcttgatgattagcattttgtaataattgaaacctagcaatattcgtggtcttataaaacaattggaaaattggaagtaactaagtcgacctcccctgttccctcatcctccttgcccctccataaagccaacattgtcttgtcttccatctttatcattgagaggttctagctcagttgggaattaagtcatttgcctgcttttgtgacacctatgcgatttttacagttagaggagggtctgctgacaccattagctccatcaaagtaggataaaaaaggagtggaaagtcaagtggtggcactgtttgttttgttttgttttgttttaaatctcactaagtaggtgtgttggggaagaaatgggtaagaaagagaagtatatgtgatagatttaagagacttttgtgtctgaaatagttgttccacagatagataggacatcagaatttataatgcaaaggcagagagaaaaaggaaagttatctgtctctcctgaagtttaaaattctcttttttatttttattattttttttgagacggagtctcactctgtcgcccaggctggagtgcagtggcacgatctcagctcactgcaacctccacctcccaggttcaagtgattctcctgcctcagcctcccgagtagctgggattataggcgctggccaccacgcccagctaatttttatatttttagtagagaaggggtttcatcatgttgtccaggttggcctcgagctcctgacctcaagtgatacgcccaccttggcctcccaaagtgctggattacagatgtgagctaccgcaaccaggctgaagtttaaaattcttaaacctttttattcacagagccctctgagtagcaggcaacggcatttgaccttctcagaaaaatgcacataaacacaccatctggcataaaattttagggagttcattcaaaacacctcatctaaagtaaaaacacagcaacttcccttactctgtcttcagaaatgatacgaagattgggataagcgacccaaaaggacatacacaaagcacataaaaaggatcattgatgctgaactaattaccaattaaatgatatatttggaattaattcaaaagaatacagagtgtatactgcgcagtgggaggggagaggagaatatagatgaaacaagattcaccttgagttgatagtccttgaagctacataggacttggggattcactgtgctatttgctgtaattatttcaagatctaacactttatttattccattttcagatactctcttaacttactggaataaagtatcacctcaggagctcataaacattcttatacttttagagtaagttatattaatttatcttcatatactttccccttatttggggagaattcaactgttacaattttttctgtttttaatagcttatttgctaataatgtagaaaatgttaaattattttgataatatagagcctgacatagaggttctttacctgcagacagaagaaaaatgtgaacgtggaatactttgtatactgctgaaactctagctaataataaaccatctttaaagcccagcaaaaggctttctgtgatctgaaaaactagaagtagtatcatctgtcgtgcatcattcatttggaacagatgctggattagtggagcagtgtaaatgattggaatttagaatttgtactttcatgtagagctgagtaattctacccactgcagaaatgtgtctgtgtatttgtgtgtacacacacacacacacacacacacacacacacacacgtgtatatgtatgtattccaagactcttggggggaaacctagtctggacatgggaagttgtcctatatttcatcctgagctatttttatatgattattggaagctaaaagaaaaattagagatagaatgaaatgcaataaatttttaaataaatagtacacgtatatgatttgtatgtgcatgtctacaaaaacaaagcatatcaatacaaaacccttggattaaagtcttacaaacttttacggaaaatgtcagaagaataaacagcagttaagatttttttttaactactgtaattgtactgaaatatttactaatgaaaatatctgatgttggggatttgctttagaaacacaggggtagggagggtggagggatatcaggggacctattcagggcagaggtcaaacaagaatagccatgagttcaatcattgttgaatctgggggatgattgggtatgtaggagttaactatggtactctccctacttttgtacgcgtttgaaatttttaataatataaagtattttaatgctattatttaaaatgtagaaattgccccaatttttagtgtggaagaaccttttagagatattattgactatgctggcgggccaggcgtggtggctcacgcctgtaatcccagcactttgggaagctgaggcaggaggatcacttgagcccaggagtttgagagcagcctgggcaacatagtgagacctgatctctacaaaaaataaaacattagctgggcatggtgatgtgcacctgtggttccaggtacttgggaggcagaggtgagagaataatttgagcctgggaggtcgaggctgcagtgagccgcgcatgatcattccactgccttccagcatgggtgacagagcgaggtcctgtgtcaaaaataaaaaatgactgatggagacctttgctatgataagttacagagcataaagggtgatttgcattgacaggttttttaaacctgtcattaaaattgtatatgaaaacatgatgtaattgtagcaaataaatgtagaaagagaatatggcaagcccgcaattaattatctatgtatttctgtatagcaaaacacttatcattataatatgatttaaataggctattctttgtaacttatgacttttaaaatatcacttgttaatctgtagaggatgttaatatattactaacatgctattgtttttctttctagagtatgcttgtttcactttagatatatggggaaaagaaacatagcaaggtaattcccatagcactgcaatttctactttttccttctcttccaacagagggcaatcttagtcatgccatgtaaaacctaggttgcatactttgagttaacattgggataccggtgatttagttaacatgtcccaattgaaagtttaaacgaatgggaacttttacattttcaagcttcccaaggagtgatgattaaagtgatatacagagtttctaccttgtgagatgcttatcttttctaaaggaatccagaagaggctagatccaggggaaggcaggaaatcataaagtgaggacaactgtaaggtctgtatttttgtctgaaaactatcaatactcacctcagttactaaagcaaatagaaatccccaacagcaattgggacataaatgatacattatctatttcctctttttgccatgtaagtcctagtgaaataaatacttaaggaaatatttgagagattctaaggtgaagaaggttacttgcttatttcaatgagatgtattttaggggtagagttagtcattaaaggagctcaaaaacagttttaaaaaatgtttaatttttaagaggctgtgtggatggggattactgttcagtctctggaacgtcctaaggataggtagtttgggtggtgagggttccaatttcaaccatgttttcccataagttggagctggtatggccattgttaccatgaacctcagtctctaggattctgtcaactctcccactacgtttactagaggataaacaaactatttcttccttagtccatgtatgacccagttgtaattttttaaatggaaacaacattaaagtaaaacaaagaaaagtttgttcatcttagcaatggacatgcttacagagtaaaaatttctaatccaaacttacctcaggttcagaaacagattagattggcattcattcttgaacatctggctctaggagtttcccctctcatttcaactcttagtgaacctctggctgtcttcttcccactcttgcccttcctcacctcctgtgaaaagattaaatcttattggagtgttggccacttatctctgatgtttttgagaagaaggagggaagtggaagctctttctaaattccttaattatattcatatatgctattttaaagatacattaaaacttcatccagtttctagtgacacttcatttaatccttgagtgtactactatgtttatgtggaaacctaattttttttagttaaaaagatgataacattgagatatgttattagagcactccagttcctgactttaaaatttattttagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagtaagtgaaaatgtgtgtgtggtacccatttgaccttaaagaagtcctggtttaaataataaaaactgaaggtgatggataccataaataccttgatcattacacattatatgcatgtaacaaaatatcacctgtatcccttaaatatgtatgaagaaaagaagtcctggtttaaattgccaatatgatgggaaatgatttcccatacatgtgtttgcatctctctgctatgtatataatcaatttcatcatacatgactataaaatgataaaatacacatggatttttgaacaattttaggtcatgatgttttcttcttagtgttaaagaaactaaatttttcccatggaattgctattctcataatatttttatattgagtattcttcattcctactgttagacttcaatgcaaatattgacatcttaatataatagtatatgtaatatttgtttagttacttttggtcatttaatgattagggaatgaacatgctgagttgactgcagaaatcggtgaatcctaaatactagtttggcaaaggtgtatttcagacaggttgaagtattgacaaggcaaatagggcaaggagagaaatcttgcccaactgcggaagctagagggttatataaatggaagctatcctatgaaaagcaaatattaataacaactcaaagagtgagaatgttttgtttccacacagtcctctgaaggtttcagaaaaggaagccagcaaaactggctttgtggtaagacctagtaataaaaaataatgttttgctagaccctgaactaatagactcaggacctttaaatctgcatgttttaaagccttcagcttcttgtaaaaatatgatgaaccacttccttcagttgcctccaagataccttgttttccttctgatttagaaacaaatgtcatataattggcataattgaaaatgtctgaccatagggcactactgtttatctgtagctgaatttctatttagtggtttctcatttttacccacataattagtggcatgacttagaaggcctcccacattatttcctagttacatcgccagagttcatcactgaaaccttgtctccaaagaggtgggcacctaattatgtcctgcagagctgttgatacagaactgtaatgaaaactaatgaaattgattaacccagactatatttgatgaaggagttaaatacagtatgacactgtgagccctcttttttttgagacggagtctcactctgtcacccaggttggagtgcagtgacgtgatctcggctcgctgcaacctctgcctcccgggttcaagtgattctcctgcctcagcctcctgagtagctgggattgtaggtacgtgccaccatgcccggctaattttttgtatttttagtagagacaggtttcatcatgctagccaggctggtcttgaactgacctcatgatctgtccgcctcagcctcccaaagtgctgggattacaggcatgagccaccgcacccagccgagccccctttcttgtcttaagtctttgggtagaaagtcattcaacaccattatgtgcatcttcgtgttgggaaaagtttaatttacttttttaatcctaggttctacaacaactgaagcagacattttccaccaggcacttcttgaaggcaatacagctactgaagtttccctaacagtactagacaccatatcatttttcactcagtgcttcaaggtaaaaatgaagagttataattcagttggtaccattgcaaagtaacattatgcagaaattacctagtcaatgtggggtagtacactgaaaaaggctggcatgaatagtcaggaaatgtggatggcagttctagtttggttatcatgtgaccctggaagtcactgagactcacttgtgtcatccataaagggaagggagtggactaacttgcccttaagctctcttctacctcttaaattctattagattttcgtatttaaaaacaaagtttccatactttaagtagccagcaatttttagcccaaaatatgattggatctgtttgcccaaatacccattgtgatgagatgtcctgtcagggtagatgatgtccgggcagtctggctggcttccctaggcgcgcacttagtgttttttctcagatgtttgcctctcagtgcaaatcatcattgctatgattttaaaaagaaggtaaaagcagttatctagcaggattattggagggggaaatgggataatggacgtgagagtgctttgaaaagtaaaaacggtgtgaccataatgtaagaactcaaaggtgaaaatcttgcttgctttcacttcagttatacagattttttttttcctttttcccctcttctctaagtaattaagttaattgcttcagacctcgagattttctatggaaacctggcctgtgcttttcaaagaggcttataaaggaaaattgaattagatactaatataaaataggctgcagaatacctttaataaataggctacagatccctttatgaagtattaggtttgttctatattaaaatgcaacacaactccatgtttcatcgtgccaataactaagaaagccattagatctcatgatgtacattgtattccttcctcctattctgatacctctaatttatttaacaaacatttatatagtctcttggtagatatcaggcactgtcctaagtgctttacaaatattaactcactttttcattgtgaggctgggaatgagaaaggggagtgatctttttgaaacaatggaaatgttctaaaattggattgcggtggtcacccaactctgttgccgaatttactaaatgtaatttaattgtatacctgaaactggtgaattttatggtttgtaaattatatctcaataacttaaaaatacaaatatgaactcacttttaatcctcataatagccttatgatgtagatactgttattattcccttttgataatggggaaactggggcccacaggaggttaatgtcaaatagctgggcagtggcagaatcaggattgagatctaggccagttataagagaccatgattctagccactataccatgccttgaaatatactaaggaaagtgccagaaaaatcaaacaccattcagggattctggctgtcagtattatcattagattgttgttgttttgggttttgttggttttggccaagctgtaacctgctggttactttcttgagggttagcaggatagggctggagaaattaaccattgctgattaaaacaaagttgacaaactaaaaggtatttctctacaatttgttgtttctttgcaagggacatttaaacaatttacatagtctgttcaattgtgatacctgttaattatctctactcatagagggcttattttttcacaaatggctaaccatatactaaacatacttttaaagtaaattagatcataatctaataaaatagaactggtattttccttcattcatacattacaatatttagtctctcagaaatacaaaggctgatttgcttgtattcattattaatttattgatttcttaattgagaagcaatatggtataggttaatagaaaatactcttcccatactagtcctgtatattgctgtgttgcattgaaaaaaaatctacctgtttaaaatgttgggattaaatattttagatatcatgtatgtagtagttgtttgagatttccaagttgaaagatggcacaaatattttgaaattatatgcaagagccttttattttcctgaaacttccaaacagtggtttcataaacaggtattggtgaaatcagttctgtcattctcagtggggcataaaccatattttttaatgttttatagacccaacttttaaataatgatggccataacccattaatgaaaaaagtgtttgatatacatcttgcttttcttaaaaatggacaatctgaagtgtcgctgaaacatgtatttgcctcactgagagctttcatcagtaaggtaaggacagaagcttgggagcagccggtgggctctcttcattgcaaaaaggaaagatgggacaatgggggtcattgtggtgacatatacaatgccagctcatgaagccattaagtactgcctttgtaaatagaaatacagaacaacaaagcacacacagagggcctaccatgaaccccctcaaatcagaagctactttttatttcaccccatcataccttcccttttccattaagctcctttgaagaatatcgttttaaaattaccaaacctgccagttctctattttgcttctttttaaaagtattgtcatgttggaggtatataagccatgagtgcactcatgtctaaacactttgaaaggatccaacttttgtaatcccagggtcttgtataatatcttggaaatggtaagcactcagtacatgttcaaatggatgaatcctgcctttcaatgctagccataactgagggccctaaatgtgcagtccacttacctcagctaaacaataacctcagacttggcttttaggaagaaatatgactgaaacagacagcaaagatttattttctgtgctcaggggctttttaaacttaagaataaacataattaaccaagatagagccaaggttatggaaaggcacagtccagatcttccactggtttatgtaactacaataagacaaagaaattcagtttctttatttgtgtaataggctagctaagctttgaaaactttttgccatcctcattatttagatagcagccaattgtgtttaatagatacagaaattagatgaatttgaagctttttattgccattctttaatataatttatgaattaatctatgggaagccaagttcaacacaagcatgttacaaaaactaagggaaagagattcagaactaattcatttaacaaaaactgtaggtacttactggatatagtccctaaaggcttattgtccagtagagggaggcacacacacatcaagatacacatacacagaaacaaataccatcaggataaaataagtctgtatagacctctgggggtgagcaggagaagaactctaatttagcaaaagtttttctgcagcaacggagctaggatttaatatggattcaccaagagatgaaactaaagatgtaaatggagtacagatcatgtggactcatcttaagagttggatttcatctttcaggcatcaggtagtcatggaagggttttaagcagggaagtaacacaattatatttgtattaagagggaattggtaaggactggggaaaatctctttaaaagttgtgttgaagaaggattggtgacaatgtcaaaggcagtaaaaagactagttgcagtaagctagataagaaatgagggcctgaagtaaggcagtgacagtggatatatgaaggatcaaaggcagatgagacatgttgaaaaaggatttacaggatttgatcatcagtccactgacagtatggtggagtgtggtggttgatgtgaaatacaggggaaagactacatttgcagtaaaagttaatgagtcctgttgaatttgagtgcctttgggacattaggatatatggatctttgctctggagagggatcagattggagagccagagttggagtcattctccattcatccatactatatttattgaggaccttctctgtgtcaagtgctgtactaggtcctgtagatacaatggagatacaaaataaatatactctttgccctcatgaagcgttcagtcttagtggggataggggagacagaaaataaataataaaagaattagtaatcatgagccgggcgcagtggttcacgcctataatcccagcactttgggaggccgaggcgggcagatcacctgaggtcaggagtttgacaccagcctgaccaacatggcgaaaccccatctctactaaaaatacaaaaattagccgggcgtggtggcgggtgcctgtaatcccagctactcaggaggcggaggttgcagtgagccaagatcgcgccactgcactccagcctgggtgacagggcaagatttcgtctcaaaaaaaagaattcataattattatatgttctaggaaggaaacaaacagtgtactgagacagtaaatgatttgtgggagataatcttatcttagataggtttgtcacttttaaaatgagacctgaatctgtaatcccagcactttgggaggctgaggcgggcagatcacgaagtcaggagttcgagaccagcttggccaacatagtgaaaccctgtctctagttaaaaaaaaaaaaaaaaaaaaattagctgggcatggtggcaggtgcctgtagtcccagctacacgggaggctgaggcaggagaatcacttgaacccgggaggcagaggttgcagtgagccgagatcgcgccattgcgctccagcttgggcaacagagcgagacttcgtcaaaaaaaaaaaaaaaaaaaaaaacacaacaacaacaacaaaaaaacagagagacctgaattattgaaaaggggccagctgtaaaaagagcttaaagaagaactatctagggagaatgacatacatgtgccaaggctctgagttgggaaacagtttgcagtattctgagaactaaaaggctggtatttttggagcatagtgaactagcgggagcatcaacatacaagtggtagttgaagccatgggagtggtttgattttccctggagggtacattgaagaagaagaataacaacaacaacaaaaaaaatcaggagcagaacattggagagaaacaacgtagaagggaggttcaaagacgaatctgtaagggagatgagagggagcagtcacagaggtgggaagaaaggtaagaaagaaggatatcatggaagccaaagaaggaaagagttccaacattgtcatgacgtatacggagtagtcaaataagaaaggagaaaagaggtctgttagaattggcaattaggtcattgatgattttagccattgcccactcagagaagtgagtgatgtgggtagaagacttagtgtagtgatgagctacactatagctatgatctcccttaaatgtttattttcataccagagtatctgcttcatccagagttagtttagtttggtgaaattattagcgagatttcccaattcccaatcagaaaacatttattaagcattcattatctgcatagaattacacttggtattaaggtgaaataaagggtagattcctatatgtgggtctaaattcaaggttcctaagaaataatttttaaaagatgtccctctagcttcactctctgaaaaacatctattgtgtatcctgaagcagcttgttatttgcttgcctagacctaaaagcatgggaaattgtaacaagtctgttacctgtatattgtgtcttccacaaagcagactgaatacattcttaaaggaacaggccacttgtctcttttgataattagtcactttcttactccttttctatgctaaaatgtatcttaactatcagtgtttatgtgaagaggatatgtgtgtgtgtgtgtgtgtgtgtgtgtgtgtgtgtgtgtgtgtgtgtgtatctcctatatcccatttgttaaaagatgaacttcacttgctgagtagattttagctataattttctcagcacgttgatgttcacaataaaggaactgttgaaatataaagcaaaagagtaagtaatgaaaattgaccttcccatttttaagcccccatttgagacccatcattcatcatttcaggcattctttcaaaacatattgagaacctgcttactgtattatggcggtgcaaaagtaattgctactatatcactatatagtggcaaaaaccgcaattacttttatatatattatattattatataatatattatataataatataatatataatataatattatatattatatatgttattatatattaatataatatattaacatataatatatcttatatattaatatataaatataatatataagatatattatatgttaatatattatatgtttatatattatatattaataattattatataatattatattataatataatatataataatataatatataataattaatataatataatataatatataataatatataatatattataatatataataatatataatatattataatatataataatatatattatattattataatataatatttaatatatattataatataatatttaataacatgtaatatataatatttaataatatatcatgtattatatattataatattatatataataaataatatattttataatatataataatatataatatataattatatataatatataataatatataatatattattataatatataatataaattataatattatataataatataatatataatatataatataaattgtaatatatataatataaattgtaatattatacaatataatatataaattgtaatattatataatataatatataaattaatatataataatataatatataatataatagtaatatataataatataatatataatattataatattatataataatataatatatatataaaagtaattgcggtttttgccactatatagtgatatagtggcaattacttttgcaccgccataatacagtaagcaggttctcaatatgttttgaaagaatgcctgaaatgatgaatgatgggtctcaaatgggggcttaaaaatgggaaggtcaattttcattacttactcttttgctttatatttcaacagttcctttattgtgaacatcaacgtgctgagacaatatattattatataataatatattatattgatatgttaatatattaatatgtaatatatatatatttatatatttatatataacataaattatatatattatatacatatatataaatatataatatatataatatattaatatataatatataatacatatataatatataatagatataatataatactataatatgttgcagactctcgagctcttctcagatctatagcatttatattcagtacttctacatctttgtaataacttatatactgacttaagttctattattatcacatgctggtgtttatgttaactagttcaggctctctggagagcagagcctgccttatgttgattttgtatcctcaaagcccccagcatagttttaggtgaggatatagagggcacttgatattctattgattttatgattggattttaaatacttatttctgttttccctgttctttagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacaggtcagtgaaaataaaagcgcctcttcatctttcttctcttcaatctttaacctctagatcaagatccagagccacccaatccagtccaatacaatgtggccatctagcacttgatgtgtggctagtctaaatttagatgttctgaaagtgtaaaatatactatggcttttgaagactaagtatgaaaaaaatagaagatctcaattgttttatattgattatatgttgaaatgatatgttgcctgtattaggttaagtatattaaaataagtctctttttagtgtggctactaggtaattgataattacgtatgtggcatgtgtcatatttctatggaatagagctgctcctgagcagagaagagcataggctttatttcaaattttattttattttattttattttttgagacggagtctcgccctgtcacccaggctggagtgctgtggcatgatctcggctcactgcaacctccacctcccgggctcaagtgattctcctgcctcagcctcccaagtaggattacaggcatgcaccactatgcccagctaatttttgtatttttagtagagacggggtttcaccatgttggccaggctggtctcaaactcctgacctcaggtgatccacccaccttaacctcccaaagtgctgcgattacaagcatgagccaccgtgcccagtctctagtttaaatttgaggactgccacatactatgtgacctggagcaagttacttccttagcctctcagtgcctcagtttctgcaaatctggtggggtaaatattgttacctagctcataggatttttatgaggattaaatgagatgattaaataacaagcttgttagattttacagaacagataacacagtttatgtttttcatgctccagtatgcccacttattttaaaaatgagagatgtgtcaaggtttagtggaaagcattgactttggaatcaggcctacctgcacttaaatcatagcttaaatccttacatgccctgtgaccctaagcaagtcactcaatctgactgaacctgttcccttatttgtgaaatgagactgagtatttcactttgcagagttaccctgaggattaaaataaggcgtgtatagtgcctatagtgcctgacacaatgtgtagcacaagatagatacttcctacatgatagttattattcaacatctccatacttttgggtttattggatgaaatagctctgaactaaaccacaattgggactgcttgactcagtagccttcattgtaatatgggaaatccttggtcctatttatatctttactgtcatggtctgtcccattagagttgtttactggagataagattattagtggggaaacaaccataagcagcttgttgaaaaatgtcatcaataatgtgaaaatctaataggaatactgtgtatgcttcctgtaaaagtctgctatataattacttttgcatgttagagtcagccatcattacacattaggtcctttactatttgcttttatatgagatggcatttggaaacccaccttcccctagaacattgttctaatttgtgtgccaatatacctgaaattcccccattggtattgattcttctgggtcaaagcatcagttttctttaagtcttttattcaaatatagacaaattaataaatatgaagacttagaacactgtctggcacataataagtgctcaataaaggattaactagtactctaatggttatgatctctttcatcctctacaaagtagggatttttatcataggcattttacagatgagaaacatgaggcacagaaaggttaaatagcttttccaaagccacacagtgaattattgataaagtcaagatttgtatctaaggcattcaactctagagcccatacacatggctattactgtatcttgcttcctaggaccagtggtaaagcatccagccattaacatcttagtatgaattgttttggcattcacccaagggagactgagagatttaaaagtcccatcaaagacagtggttcatgcctgtaatcctagcactttgggcggcataagtgggtggatcacttgagcccaggagctcgagaccagcctaggcaacatggcaaaatcctgtccctacaaaaatataaaaaattagttaggtgtggtggcacacatctgtagtcccagctacttgggaggctgaggtgggaggatcacctgagcctgggaggttgaggctgcagtgaaccagtgaaccaagaccgtaccactgcattccagcctgggcaatagagtgagaccctgtcccaaaaaataagaagtaccatcaaagtccattccataaacttctgttaaactaggtaaaccctggtcaaaaacaaagaaagttgctgaggcactggacttggaagtccagccaactaaaatagactagtgaaaaggaatgagaaatcatcaaagaaaaacatgatttattctcacctttgccacagctacaacctagaaagcatatttaaaatggagacctgactaccattgtatcagttcactattatgaaaatagttttagatctggctatgctatgagttttgaaaaattgtttacgtctaaccaagaaagatcctttaaaatttgaaatagggcctttcaagttactatttcagcagaagaatgtaaacccctcatgtatgaagggtacattatgatggtacagtgtagaatctttaaaagaagcatttcatgtgagtgcttatatacttataaaatgatgagcatagacagcatttgttcaaaagttatttggaaaataatatttacttcttcccacagataataattgctgtaagccaactgatagctgatgtagcactaagcggaggatcaagatttcaggagtctttattcattatcaataattttgcaaatagtgacagacctatgaaggtatgttctcatttcagataataaattagaaccacctttgctatcagggaagtttaaactcttaaactgtcattggattcacaacttttgttagtatagaatgtacggaatgtgagttttatgagttaagggctttgtcttatacatcactatatctctagtacctagaacactgcctggtacatagcatatattcaatatcagtttagtggatggatgaatgaatatactatgtattcatagttgttatggcaagtcgaatctgaattttttttttctgggcttcatttccaaacttgctcagaaaatacatagatcctttatttcttaacaattgtcaccacttttaatattggttaaaaaagcactgaatttgaaatttcacaaaatttcacttagaatagctaacagttgcctgatccattgccaatggatgagaaatggcacagaagggattcattatttgatggttttgtgagttttgaaaattatctgttaacaccaaggctgtcactcttaagcaccattttgctgaggccaaacccaagactctgaccactgttccactttctttcctatatgcttaaaacttatagcactgtaaaaattcatctgttgctttgttgcgtagagtgcaggttctgatcttcagtgacacatgtatacaagggaagaagaatcctttgccaataggacttttcctcccagaagaatgaatcatccccattcttgggaaaggtcatcttccagcacagtttgacaacattgtgtaaaatctgaaaaagattaaaagctcatagtcacagcatatttgatgtttggatgtgtagaatctaagtaccaaaaaatattcccataggaatgttgcttgtactgaaaaataacagcgtgtagtgccagccgctctcaggctgggaaagtttgctttccagccagttctactagttccgcaggggatcagtatatgctccagctaatcttgtgagcatagaaacaagttacaccacttatgcttatactctaaggaattgtttttaccagttgttaccatccttagtactatgttatataggtagattggtaagtttttctaggtaaatggggcttgtatattctctccttgataggaaatctttttcttttccatatctcatttatgaaatgacttagttttattctgttatggcagtcattaccaacaaaccctattacgaaaagatacagctttcccctggtaaatgggatctctattaatgtatagaaaggaactttatgtatataattattatttttaaagggagtcaaagccaggtaggtattttttatttctattgtatttatttatttacttagagacggagtttcactcttgttgcccaggctggagtgcaatggcccgatcttggctcactgcaacctccacctcccaggttcaagtgattttcctgcctcagcctcccgagtagctgggattacaggtgcctgccaccacgcctgggtaattttttatatttttaatagaaatgggatttcaccatgttggccaggctggtctcgaactcctgatctcaggtggtcctcttgcctcggcctcccaaagtgctgggattacagtcatgagccactgctcccggccaagaaggcagtgtttcaaaccatttcccccacatattgtgtttatattgacaagctccctaacccctgtacctgtctcttcctcatcatctctgaatcatatagataattgtgattactcctgtgggggttaagaggatgcaataggacttccttagcagtggctagggtaaagaggaaactctggtattcttggtgccaaaaacaaactttgaaagcttaatgatctctctaaactttctggaacgttctgtgattcatgacctcccatttgtgtaaacagaaatttctgcagtatggttttcaccttagtgtatgtggtagttagtggatggagtaggcatgcttatcagaatggaagagtggccaagagcaccagctctagggccagactgcctgggtgaaaatcctgtctctaacatttaccaattttgagactttggtcgagcatttaaacacttttttataatagtgcttaactcatagggttgtcgtaaaaattaaaacatgtaaagaacccagactagtgcttggcacatagtaagctattagtttttagttactgttacaagaaaacggcaaacaaagatcactcccatggctgtgcaattcacaatggaggatctgggattcaaagccaggtagtctggctccagagctaatgcttttatgtcctgtgaatgtactgccaccaaggttagagcctttgaagcctgggctagttacatatttaaaaaataatttatttaaaattatttcagtgtactatatgcaataccaagaactgtaacaggaagtgaaaatcatatgtcctcagcattggatgacaagccttagagcacatcgatattgttgttcaacttgtcttttttgtttgttttgaaattaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggtgactacttaaagttttgttctaaacagcccttcaaaacaccttgagcatgttctgacagttctttctctgtcatcctttttcaggctgcgatgtgttatgtccatgtagcagctctagttgcagagtttcttcatcgaaaaagtaagatatttctgtttttagagatggggggattttcatttagcataatagttttttatctttgtagtttagctatgaatatgatataatagaacactgaaaaatatgttcacccttggccttattcagtgttaaaaataagctgttataaaagaagactggattgtttgttgtcccttctgctttcattagagattacaagaaaagttaaatagtacagggtggccaggtgcagtggctcttgcctgtaatcccagtgctttgggaggccaaggctggaggattgcttgaggccaggagtttgagaccagcctgggcaacagagtgtgatcctgtacctattttaaaataaaatataaaatataaaaaaaaaatagtacagggccaggcctgatgcccagtgtttattttccaagactgtccctccctggaagactgccacaaattaaactcttctcaaggctcaagtcgggataacacagattatttgtttccccgtcatgtgtcttaacatcaccaaactgcccatagactatgtctctccagccactttagtgcagtgatacctgggtactaaaagggagtcatactcttgaagggctttaggtccagcagccctggattcctaatttaagattcctaattcaggaaatctacttggaagtgtccctttccataaacagtattgttggctactgctcaacagtattgttgaacaaactgcatctgctcaaatagtaacccagttgagttaggtttaaacattgattggcaatggagctggcaaccaagaaatctctatctcaatgtccaagctacttcctttaaggcagtggaatgagtaacaatacggcaaaatgaaaccaacttattaaaggagtcatatcactctggcttcagctgtacgaacacaaccatattttgttttattttttaattacagaattcctacagttaactgtatatctatcatttcacactgaggctcagtgtttgattgcctcatataacacccatgtggagaatctttttctaaaaagattcttggccgagtgtggtgactcagacctgtaatgtcaacactttgggaggcatgggtaggtggatcacttgagcccaggaatttgagaccagccttggcaggaatggtgaaaccccatctctacaaaaaatacaaaaattagctgggcatggtgtcacatgcctgtggttccagctacgaaggagggtgaggtaggatcatagcttgagcccaggacactgcacttcaacctgggtgacaggacaagaccctgtctcaaaaaataataaataaataaataaataaataaatgaataaataaattttttaaaaaagattcttcttaagtaaaatgtagattcattttacttatattttaaattaacactttctgtctgactctggaattcttttgaataatctatgtgtttgatatactttagttttctccttttagtatacatatgtgagttttaaacagagaaggagattaattaccaaaataaggccccatttgagggtttttttaaaaatcactggtatgcatatgaaatcacagtataagtaaatattgaaattacacacctgaaattccaaataaactgacaagatatgagaaccttaaacggagtaccgtgatttcaagtatgtcttcagagaaatagattaatattatctcatctttttaattagaaatctggccaggcatggtggctcacgcctataatcccagcactttgggaggccaaggtaggtgatcacctgaggtcaggagttcaagaccaccctagacaacatggtgaaactccggacgttgtggcacacacgtgtaatcccaactactcagaaggctgaggcaggagcgcttgaacccaggaggcggaggttgcagtgagccaagatcacgccactgcactccagcctgggcaatgagaacaaaactccatctaaataataataatagcagtagaaatctgaagatttttatgtccactaagtctaaaactgtactttttagactttgaaaatagttaattatattaaaactatttcctggaatgtttttgtttttttcacaagtgcagagacattaaagctaagcaaaaatcaagaattatttgtctttattatcagtccttaagctttagaaatataatttcttgctatggtttttctggatattagcatggggcagctagcataaacaccaaactgatacatttcaggaagtggaaataatattttcaactagccatttatatatttcataataccctcaaggtttcttagaatttattcttcatagaaatcaaagcactcttcactaatgaggagaaaatgttgttttgaatgttaaaaaaaatgatgtttaagagaatttacatatttatttataggtgtcatctatttttaaatttcttttaattaaattttattttattttaagttctgggatacatgtgcaggatgtgcaggtttgttacataggtaaacatgtgccatggtggtttgctgatgccatctatttttaaacctggaaaattctatttgcctaaattagaaaaccttattctaaaatagtggtagtagtaaaagtcctcagggttttccccacttagcttcagtgatccaaaacaccttttttttcttaattagctgattcaactatgctagctataccgaggtcgactaccaatttaaaacacaagttaaaaacgtaaactgagtattattctaagtgaactaactcaggaatggaaaccaaatattgtatgttcttgcttataagtgggagctaagctatgaggatttaaaggcataagaatgatataatggactttggggactgggggtgggggccagggaggaattaaagactacacattgggtactgctcgggtgacaggtacaccaaaatctcagaaattactgctaaaggacttatccatgtaacaaaaaatcacctcttcctccaaaactattttttttaaaaaacctgtaatctgttaacctcccatccattctgagaaagcattagtgagctttttgaagtctagataagacccggcagttgacagagtaaatgaaaatacatttgagtgcagaactgaaaaaaaatcattgaatttacacttaagaccaacgtatttgacaaagataattgggcacctttagaactctttgttttctatcattaagtgccctttgataatgaagccaagagggaaggagcattagagtatattttaaatccctgatacatatccattgccaaaaatgttttgttttctctaattcctaaccagtttctcttgaagtacattataaaacatttttaaatcaagatggaataaaatactactcatcagttgacacattggaagcagatgttctactgtgtagcgtttttaaggaaaaaaaatactttgccctattggatcattgcctaagcagggaagggcttaggggcccttgcccctcaaaggtgactgcacagcacccacaagggaccatttccagatccttttcttcactgtgtcaggcactgaattgacaggaaaagggaaaggaggtatgcagtactccctgcccccaccctcaccctaccctcaaacttctttcaggcagcctgagctcttgcttgttctaccaaagagacttaaggatcactattctcttccctttattgaaggcacctcaaagtgataatactgagtgtcagctattctccttcctcccaaaaaatataaaataaaaaatgtcagaatttgcttatttttattttgtttgagaacctcaaattttctagatcacattctcccttttttcttttcctaagagagggtacaactgttttccccagggaagacaagagtcaagtctctgcattctttcaccaccaaatagcatcctaggttcagcaaagcttcaggcctgcaaggattcacccatcaacccagaaaaaggaatttcctttcccatagaatctggtttttttcattccttacagggtaatgttgctctctttcccaagacgtggtatccaggatctgatagcttgagtttcatgaagctttttattccctcattctttcctagtcatagcttttccccttcttatcctcccctcaggactcttagctcttatccttcttctgactggccatcctttttaatcaagggttgcactgctatcccatcttccacaccccttcccactttttttcacgggataacttggattcagggttatggtctctatctgaacagtttccatcttgctttccctagaacagcagtcaggaatacagaagttacagctataaacagcaaggtcaagagtcctggtcaaataccagagaaactgatagcagactctccaggaccaccttctacagggctgcataggtctacatgagatccctcaaacagatgcatccttctgttgggatatgtacattggccaattctagactcagcaacttgtttcatctgaaaatctttctagaactaagaggaatcaggattttctccaagcattttaaagattctaacaaagggtcgtgatgtaattggatattgatgggtgttgataactttagcaaaaagggggaggaatatagtcatctctgggtagagatccattatcaggcagatgcattaagataacacacttagcaagaatattggactctgaagctgaaaattcacaatagtagtctttgcactagataacccagacacgactttcaaaagtgggtgtttatgtctttgttcctgagataaaacataattttccctacttctacttaagatacaccggaagactctagcaagatgcttttagcctcatctcatctggcataggagtgtgcctttcttcatcctcccttaaatcccagcattctagaaaagccctacatttggaaatgacttaaagtaataatctcttttgaacagatgggaattttttttctcccagtcatggacctagctgcctgaggccttcagggattcactatcttcttcaataaaggctatgttctttgtctcttcactcaagtcttgggccctcttctttacggcctggctcttgacctgatagtgctgatcaagtgggatggtttcttctacatttcaaaaagttctcctaatgcgctactgcacaaagagtatcccacagaccagctgctagtctgagaactatttatcacatgtttacaacaagataaggagtattgtcctgaatgtaaattaaccatgtcactaaacactctgtttgttcaactgacttgttccttttaatagaaagactttgttgaagaaggaaatgaggaattgatttacattctggtgaaagttccttatctttttatggtccagtactttgaatagaactctctagaggtcttgtaacagaccattttaggcatgcttatcttcagaaatgaagcaggctatgttttatcttcagcgccttttatttattattattattttttgagatggcgtctcgctgtgtcacccaggctggagtgcagtggtgatctcggctcactgcaagctccacctcccgggttcacgccattctcctgcctcagcctcccgagtagctgggactacaggcacccgccaccacgcccagctaattttttgtatttttttttttagtagagatggggtttcaccctgttagccaggatggtctcaatctcctgacctcgtgatctgcctgcctcggcctcccaaagtgctgggattacaggcgtgagccaccgcgcctggcccaatgccttttattatctactttatttgaacaaaaatggtcctacagcttggtgggtcaaagtaaatatcactttcattcctggggctccttcttccttaattaaaactcactgactactcccatgtatttctcccttcttgaaaaagtatttcaaagccaggcgtagtggctcacgcctataatctcagcactttggtaatctgagatgggtaggatcacttgagctcaggagtttgagaccatcctgggtaacatggcaagacctggtctctacaaaatatataaaaatttgccagccgtggtggcttgcaccagtagtcccagctacttgggaggctgaggcagaaggatggcttgagtccaggaagtcgaggctggaatgagctatgatcacgctactgcactgcagcctaggtgacggggtaacactctgtctccaaaaaaaaaaaaaaaaagtatttcaaaataatcctatcttcccctagcagactttcatctttctctcaaagaagtgtggttcctacttctgtgtgtggttcctacccatgttctgttaagcagcttacccagaagatacatgtctagtgattaggtttcatttagacaagaagagttggaaaaatccaagccctgatatataacctcttttccaccagaattctgagaaatctcttcaacatgaggtctgattttttttttaaaccttccttcttccttccccaacctctaacaggaagattaccagatacttaattgtaagtaaaggtcattatttgtaagtatcactgttaggttgtagaacagtagattgcaacagccatttttttgtgtctgtgtgactagctcctatcagaaggaaactttttcattgaaacgttttcaatggttatgttataaagaggcagaattttccttgaactctaaaattacagcccacttagataaaggtaaaggcagacacagtaggaatgtttacacatgttcccctgtctagaatctataggggaaccatgtggcctttacacctcgactgttgcttgacagtaacaatttggtccagaagcctacagcaggtgttctcagcttgagttcacttcctacttcccaggagtccagctggcagccattattttattctaccttgagaaggctagtttatttattggtaggcttatttgctagtaataattcattgagtacttatttactaggctccattctaaacactttacatttcatttaattctcatagcatagttatttattatccctgttttacagatgataaaactttttatagtcccagggagataaacattagcacaaaatcacacagttagtgatagagctgagtctatgtaactccaaaagtggtggttcttccagtgccccatcctgttttctctaggatgcttcatccctgccatctgttttatttcctgactctcttaaaagtcctaggccagaccttctccaacatctcacttcctctcccaaatctcagtgaaattaggcactagacatggttaccaaagatcacttagtggttacctgaaaagtgcctgccctcttgtttagatgatagaacacaaatgtatacaggatcaaagtttaaataaaaatgtttagattgcactaggtaaacatctatcctagccattgaagatgatacatagtcaaagaataaaagttattcataactaacttaagctcactttgtagggggagaaactaataaaatatgtagcaaatggaaacaaatttaaaaatttttgtaagtgaaaattgtacttaagactttgattcttacaaaaataatgtgtttattttaaatagcccatctctgtaaggctcactgttatttactaaatgctttctcataaattcactccactgttttttttattcacacagaattatttcctaacggatgttcagcgttcaagaaaattactcccaatatagatgaagaaggagcaatgaaagaagatgctgggatgatggatgtccattatagtgaagtaaggattccagggcctgcattgccagttatataaatttcacttcttaaaattcatatatattaaacaattattacagctaacctaattttgaaggtaactaagggttaatgaactttaagtattaaaactgtccagggcaaagatgttcctgtttagagggccctgtctcttgaactggtcccattgtctagttttagaaatacagcatttgccgtcctcaagtcaccattccaataactagataagagtcaacacatgttggaaatttttccataaaaaatagagttaacattgctctttacttcaactaagacagactatgcacaaaagtatttttaaatggaaaatttctgctctaaacaccacatggatagaaaacagctttggctgtcagtcaaccaccaaagatttattgaacattgacttaacagcaaggccttggacttggtgacctaggagctttaaataattaaatatgattagtccctgacctccaaggtccacctgaagagataatacatgtacatgaaatggaaaaaagacttttgaataatatttgaataatgcagacaatatgtgccatgcaaagtcaaaggtgaaagatgccttagagctcaggtaaaataaaggaagtatgatcagagagggattggaagaatgaggacaccctgaaggcatcctaagagacaggagaagggcagggaccacgactaagaggtaggaaagtgtaagacatgtttgaggcacagtgagtggaagtggatccttttggctatagcagtaggttcccatagagaagagtattagttgaggccagattttgagaaactttcaatgtttgggctttattcagtagaatattaaattggcatcaaagtcttttttttttttttttttttttatggagtctcgctatgtcgccaggctggagtgcagtggcgcaatcttggttcactgcaacctctgcctcccgggttcaagtgattctcctgcctcagcctaccgagtaccagggactacaggcgtgcaccactatgcccagctaatttttgtatttttagtagagacagggtttcaccatgttggccaggatggtctcgatctcttgacctcatgatccacctgccttgacctcccaaagggctgggattacaggcatgagccaccgcacctggcctcaaagatttttgagcaggatgatgactacatgaaagcaaggaagagggaaggctaatttggtgatgatgtgggagatgtattgaagatacagggataggagctagaggcaggggctagagagaaggctgccctaattatccagatacgagtagttaaggcttaaaccagggtagtgaaagattcaggaaatagtgtgaggaaaagatgctgatttgctggctgtgggaggggaagggtcaaaggtagctctaagatttcaggtttggaggttaagggaaaatgatagatggatggttttgcaggaaaagtgatgaatttcattttataggtgagttgattttgatgtgaaagcttatcaaaatggaaataaccatcaagccattagaaatgtggaactgaggctgggcgcagtgtctcacgactgtaatcccagtactttgggaggctgaggcaggtggatcacctgaggtcaggagttcgagaccagcctggccaacatggctctactaaaaatacaaaaattagccagacgtggtggcacctgcctataatcccagctgctcaggaggctgaggcaggagaaccacttgaatttgggaggtggaggttgcagtgacccaagattgtgctactgtactccagcctgggtgacaaagtgagactgtgtctcaaaaaagaaaaaaaaaagaaatatgaaactgaatctaaggagagagattagggttagaaatacacatctggaagtcatatccttatgaggaccaaagcagactgaatgttagacataataacggcaagtgaagaccggagaatcaaggactgaaccatgggggaaaagttcacaaagagtgtgaacgtagaaaacaagaaagaaacacagaaaagagattgaagttacagtcccataaaattacatttcttaaaaaaattgtattaaacaatgagatgaaaattacagtgacacacttcataaacactttatgaattgattttttaaaatacacaaatctcaacttagctctggcttatttagttaaattaatgatacacctagaagctttacctactatttctacatagtctgtctccctatcagtaaaataaggacaataatactatcgtggtcacttcacaatacatgcgaaaacttaaaaagtcatgaagtgtgagaataatgtcaggttttatcattgacctacttggcagtgagatttcttaaaagcaagttggtgtccttttaccctcagaacctacaaggatagatacttaaaatatgtttgttgaattgattgatcataacagagatgcaagatacttgaatttttattccagcttaatttttgactgtatagccttggacaagttaattcatgtttctggatattagttagatgatttcccagagacctgcaggttttacaggctgacagcaggaagattcagaggatttcatggggcttaactggttcagtacaactgaacttatatccttgccttctaaacagcagcttcagtgtattcatagaaatggctttgagcttgacccttttttatactcttaaggagagcaataacttttcttaataatcaaaaactgtaattagttttctgtataaacacatttgttggaaatcttttgggttctacaagtaatttatacatacttctatttgatatatacaggtagaatcatgttttaccaagtgccactttatttttcagtttgcataataaggcttcttccttaaaccctagccaattaaaaaaactgacactgatttagaagttacattgaaatgaaaaatacaaacagttgtccatttagtgcttgtatttaaatatgtgagttaaaccggtaataacgcaatgtaacttgtttccaaaaatgtatttctgacttgatttgcaacagttttttttttctgcatgacaccacctcaggaggtcctgatgacgtgtgcccctgcaatcgattttaaacatataattaatatataattgggctgggcgtggtggctcacacctgtaattccagcagtttgggaggccaaggcaggcagatcacttgaggccaggagttcaagaccagcctgtccccatggtgaaaccccgtctccactaaaaatataaaaattagccgagcgtggtggcacaggcctgtaatcccagctattcaggaggctgaggcacaagaatctcttgaaccccaggggcagaggttgcagtgagccaagatcgtgccactgcactgcagcctgggcaacagaacgagactgtgtctcaaaaataaaaataaaaatgatataattaatatgtaataaaatcttaaacaatttgatgaattttgacagttgtatacacccatgtaacctaccatcagaaacaaaaaatagaacatgcccattccttcgggaaaggttcccttgtgcccatttccagtcaggctccccacctccaccatctgatttctatcaccatgaattagtttttatggcataaaaatggaatcaatcattcaatatgtacctttttttaatctggcttctcttgtttaacctaatgtttttgagattcatccatattgttgggtatatcaaaagtttgttctttgtctttatatacaaattttaaatccattcagttgatggattttgaattgtttccagtttcaggctgttacgaataagtctactttaaacattcctatctatgacttattgttgacatatgctttttttctcttgggtaaatacctaggagtagcattgctgaatcctagggaagatatatgtttaacttttaagaaatttccgaagagtttctcaaagtggttggaccgttttatactgtttgccagtagtagatgagagttctagttgccccacatcctccctagcatctgatattgctgatctttttaaattttagccattctattaatattaggtgtgaatcaacatctcattgtggcttttatttgtatttccctaataaccgatgatgtctaccactttttcaggtgttccttggcctcttttgtattttcttttgtgaaatgtttgtcttttatccgttttagaaatcacattgcttactttttattgttgttttgtgggagttctttcctggatataaatcctttgtcaagatatatgtgctgtatatttctttaccagcttctgacttgaccattcactttcttaattgagtctgtggttgagcagaaaattttggttttggttgtaattgatgaaatccagtttattattttataataatttgttctttttgtatctggtcccaaaaatctgtgcctacctcaagatcctgatagtgttgtcctgtgttttctcctagaaacttgtttccgagttttgtttaggtctataatatatttaaagttcatttgtggaatgaaatagaggtcaaagctctttttttaagacagttttttttttttttaagacgtaccatttggggaaaaacaagactttccttttgtcacgttgaatttactttggcaccttggtcaaaagttcggtttttcatatttgtgtgggctatttctggattctcggttctcttccactgatctatttgcccatcttgatgccaatatcacacttgattactataacttaagtcttgaaatcaagtagtgttagccctccagctttattctttttcaaagttgttttggctattctacgtcctttgaatttccatataatctttagaatcatcttttctacttcctcaaaatagcctgagaatggagagtttaacaatattgaatttctcaatcaatggacatttatctgggttatctttaactgccaataatattttgtagttgttagggtagaagtcttgggttagatttactggtagatatgtgatgttttgatgctattgtaaataatattgtttgcttttatatttttattttttattatgttgttgctagtatatagaaatataattgattttgtatgttgatcttacgtcctgcaaccttactaaatctgcttattagttttcatagtttgtatgtcttttatgattttctacatatacaattatgccatatgcacggaacaattttactttttctaatcctgtatgctttttctctttctcttgccttattgtactggctagaaccttcagcataatgttggatagaagtggtgagagcagacattctaacttgttctcaatcttaggagaaacatgtctagcctttaaggtttttagtaaatgccccttatcagattgaggaagatctcttctattctttgtttcttgagttctttttaaatatcatgaatgggtgttgagtgttgtaaatgcttttttcttgcatctattgaaagagatataatttttcttttttattcagtttatgaggttgtatattacattgttttttttttctaattgtaacctaactttacattcctgggataattcatactaagtgtgcaccttatttttaattcccccaatgtttgtcccaaaattgctggaaattttaatttggctagcagatgttaatatacagatgttttattcaagtagcaacatttatttcacatatactatccagtgacactaaaataattactggaaaagccaatgtaagtaaaatattgtccctactctcaaagaatcacagcctattggaaaagtcagatatgtagataatacgtaaataatgtacaaatatagtgataaatctttgccaaaaaagtagtgaaatagaaaaaaagatgtgtagtgtcttgcctaccctatattgataaggagaaggatcctggaaaaggtgatacctaaagtgttttaaagagattaaccaagtagaagggattaaagggaggaggggcacagcctgaacaaagacataaagctaagacacaccattgtgcttcagggaaactgctagtagttcgctgttgttataacataaagtacaaagtttggtatgatgaatgatgagattatggaagtatcagccacatcattgcaagctttatgtgccacatgaaggagcgtgtccgttgttctgtgagtgatgcggagccattgccagattttaagaaagggagagtggcacgctcaggtttgcattttaatcagaaccctatggcagatgtgtggaagatgtatttgaaagggctaagactggaggcaggaagataaattaagaaaaaacaatagtgaaattttgcaccttagcaatgagagaaatggagagaaagggtcagatttgagaaatatttaggaaataaaactggcaggacttggtgatgaactcattagagaatgagtaaagaaagagggtgtaatagttgcgtagatatctgagcctatttgggcttctataacaaaataccagagactgggtaggttataaacaacagaaatgtatttttcactatactggaagctgagtaggtgaagataaaggtgttagccgacttggtgtctggtgaggatcgacttcctagttcatagatggtatcttctcactgtgcccttacgtgatggaagggggtgagctaactctctttttattagggtactaatcccattcatgagggctctgccctcatgacttagtcatctcccaaagtctccacctcctaataccatccccttgggggttaggattttaacatacgcattctgagtacacagaaacattcaggctgtagcactaagactgcaatatcaaagtaccacaaattgggtggcttagaacaagagaaatttattgtctcacagttctagagtctagaaatatgcagtcaaattgttttcagggccatgctccctctaagactctgggtagaagccttctttgtcttctggtggtaagagttgttccttgacttcccctgacttgtggctgcatcactccagtctctgcctctgtagtctcatggtgttttccctgtgtgtctctgtcttcatataaagataccagtcatattggattggggcccaccctactccagtattgcttcatcataaatgatcatatctgcaatgactttattttcaaataaggtcacattctgaggtacttggggttacaacttcaacttatctttttaggagacacaattcaacccataacagacaataaagtcaaaactgtgcttagtttactacctaagggtctataggatattgccactggtgagataggaaacacaggtataagagctagaagatgaattcgattttctaaaggacatacaggaagagctgttttaggaatcagttctacaggtttgaagtgcatctctttaagatagaaacaagctgttatgacttacgggtagcatcagtaattggcttcatgttttcatcgttgagaacatgagatgaaggttcacaaaagagttttatagcaactgttattctggcagcgctggtgatctctattttgagctgttatcctatcattctcagtaattttagaaccatcagtcgggaagtgttctttatcaaaactgagtcattttaataccaacccacaaaaataaaaactaaaaaaatttaaaaaaacatcgaatcattgtaataaacacctaaaccaccaacacaatagcttgaaaaagttgtcaaattttcttaagactaatatgggtaaatattgttttaatataaaaaataatagatgttagacattcagacatcctcaatttggaacaaacaatatattccctttttaaaaatattctttctcgatgtgttaacgtttacaactatagttaacatcttcattatgtgaataaacaaaataatcatagtttactattgttaacatcaattttatatttttaagaatgtttttaactttaaatattttaaatatttgatttagaaaatatcgtcacacaagtatgttccttttgtgcatctcattgaatttagtaccatctgtttgttttctaccaacttgaaatgcttcaaaatttatttgtccaaaactctaaaactatttttaattcctaattggatttttctcttaatgcaggaggtcttgctggagttgctagaacaatgtgtggatggcttatggaaggcagaacgttatgaaataatttctgagatttccaagttgatcgttccaatttatgagaaacgtcgtgagtttgaggtaggcaatttgaacatttttatcattgacttatgtattttattttggttttagggaaaacagtaatatagttctgtcactattattcgacttgtgtcctctgaagaatataaggttcattacattatgacttttgcattttatcatagagtatagtctatcattttgacacatttgtccaatttcaaagtgacaattcctaaaaatgctattaaatcctgagattttttaatgatttcaccacaaaggaatgataaatgtttgagatgatacatttactaattaccctgttttgatcattacacaatgttggcatgtatggaaacaacatttcccccataaattgtaccccataaatatgtacagttattatgtgtcaattaaagacaacataaaacttcctctggtcctgcttatgaaaataaagtaaaacttaaaacatcctaccttatattcatttatgttttccaaatgaaattaagggtaaaagatccaaaatagaaattgagatttaaattagaccagtggttctgaaaaaaaaaatttttttttgagatggagtctcgctctgttgcccaggctggagtgcagtggcgcaatcttggctcactgcaacctctgtctcccgagttcaagcagttctcctgcctcagccttcccagtagctgggattacaggcatgcaccaccacgccccgctatctttgtattattagtagagacggggtttcaccatgttgaccaggcttgtctcgaactcttgacctcaagtgatcctccggccttagcttctcaaagtgttgggattataggcgtgagccactgtgaccggcctgaaaatatttttatctagcaacctcccctcttcctctcagagcgtaaaataatcagtgttgttttcactaaaccttcacttcaaaaagctgtcaaatttccatgttacccagggaagaggcatagacatgattctattctttataatttagcggagaacctaaaggtgctggcaaatgacagtggggtaggtaataatacactagtaatacccctattatgagaattttaaaattttgacttgccagataaactattgataaagtttagttaataaagaatagtagtataatgcacagcaattgccaccagcactaaacaggattttttaaatattcaagtctcttagtccatatcataatttctgttgctactatgctgggaagggatgatttaggattcaagccattttaaaaaagcaaggcaatttattctttttttttgttttttattttatttatttagtttttttgagacggagtcttgctctttggcccaggccggactgcagtggcgctatctcggctcactgcaagctccacctcccgggttcacgccattctcctgcttcagcctcctgagtagctgggattacaggcgcccgccaccgcgcccgactaatatttttttgtatttttagtagaggcagggtttcaccgtgttagccaagatggtctcgatctcctgaccttgtgatgcgcccgccttggcctcccaaagtgctgggattacaggcgtgagccaccgtgcccggcctggccatgtattcttaaataaagcagttaggcctttccttgttgacgtggtttctgagagtgaacacacatagatttaatataatctgagtagtgttttcatctctcctccaaactagctctgatcaaattcactttttcttcccagattctaggtcttcctctctctgccatacttttggtgtatatggggcatgcctgaaaactcatagtagaattcaagtgaatatattaataagctgaagtataggtcatacagatggcaaagaatagcctatgagacaaaaccagatttgccattacccctcctatcaaagcattacatctgaagaacctttgtagtaatttcaaaataaagtccccattttttgactcttaggatgaaggaagttctggctgttagaaacccagggagccttttgctacttagccaaccaacagggaagaaagaaaaatatatcttctttatacattaaaggaaatgatgttttctacaggggaactactcctatttccttggaggggtgtaagggtctgtataaatcccctagaactctgtatagatgaagtaattgtgtttaagactgatgtagctggagcatggtatacacgcctgtgattccggccacttgggagactgaggtaggaggattgcttaagtccaggagattgaggcttcagtgagctatgattgagacactgcactccagccttggctacagaacaagatccaatctcaaaacaaaaccaaaaagtagaacactgatgcatactttttcagtgtatctctatggaacgggctgaaaactatcagagatagcagccaaagtaaggaagatttccctccaattgagctcaattataaaagataatatgggaggaattttagagaaagaagcttgtgtgtttttccttttttgttgaggtgaaatttatataacatacaattaaccattttaaagtatagaaatcctattatcctatcattctcaatatgcacccaccacctctttctagttttaaaactttttcatctccccagaaaaacactccatacccattaagtaattactccccaccccactcccattttccaataaccactaacctgctttctggatttgcttattctggatatgtcatataaaaggaatacagattgagcctctctaatctgaaaattcgaaatcataaatgctcccaaatctgaaactgtttgagcatggtcatggtgctcagtggaaatgctcattggaacattttggatatcagattttcagattagacatgttcaattggtaagtccaatgcaaatatttcaaaatctcaaacacttctggtccaaagcatttcagataagggatactcagcctgtgatattatatgtgaccttttatgtctggcttctttcagttagcataatttttttttaattgagacagaatctcactctgtcatcgaggttggagtacaatggcatgatctcagctcaccgcaacctccgcctcctgggttcaagcaatcctcacacctcagcctcccaagtagctgggaggtgcacaccaccactcccggctaatttttgtatttttaatagagatggggtttcaccatgttgtccaggctggtctcaaactcctgacctcaagtgatccacctgtctcagccttccaaagtgctgggattacaggcgtgagccaccgcacctggcctgttaacataatatttagaggttcatgtatcagttgtagcatatatcagaacttcattcttttttatggctgagtaagattccattgtatggatatactgcagattgtttatccattcatccattgatggacatttgggttgtttcaccttttgtctattatgaatagtgctgttgtaaacattcatgtgcaagtttctgtgtggatatatattttcaattctcttgaatatatactagggagtagaattgctggatcatttggtaattctatgtttaactttttgaggacccacgaagctgttttccacagtggctgtaccgttttacatttcgatcatcagtgttctaggattcctattacttcatatccttaccaacattttttattttctgtttgttttattttgttttataaaatccatcctagtgcatgtgaagtggcacctcattgtcttggtttgcatttccttaatgacagtgagattgagtgtcttttcgtgtccttcttggctgcttgtacatctttggagcaatgtctattcaggtcatttgcccatttttaaaattggtttgcatatattttgttgttgagtggtaagaagtccttaaatattctgggtactaaacccttatcagatctgtgatttgcatatattttcttccattctgtagctcgtctttcacatttttgataatgttctttgcacaacgtgctctctttttctggaagtgcggaaaaacatatcctttggaaatatctgtgaacttgcataaaagcagtcctcactgcagcttacaccattgcttatttttatatttgcattttattttcctttttaaatacatggattgtttattctcatagctctctacctgagggctcaagcaaagcatttggctgccctttcagttaaaaatattccgatcctgtagaaaatagtagttgataatacagtatttcaaaatttaaaatttccattgagatgtgaatgaaatgaagcatgatattaagaaatacattgtcattgaggaacagaaaaccacataccgcgtgttctcactcaagtgggagctgaacaatgagaacccatggacacagagaggggaacaactcacacagggcttgttgtggggtggggggtgaggggagggaacttagaggatgggccaataggtgcagcaaaccacgatgacacacatctatctatgtaacaaacctgcatattctgcacatgtatccccccttttttttttagaagaaatttcttttaaaaagaaatacagtgttattttaccattttaagttctacccttagacctaaagttgttgaggactttgattgttacaaagggagatgagtatgaatggccccaccaagaccattttgaaaagaatatactggtgctttttatttttgtacattcatcttgaagacatttagtaattaaacaaaaaacaaagctgatttgtatatttttatttttcagaaacttactcaagtttatagaactcttcatggagcttacacaaaaattctggaagttatgcatacaaaaaagagacttttaggcactttcttcagagttgccttttatggccaagtaagtgtacttgaatccataaagttttcctttttaaacattcacctttgaattactagtttactatagcagctaggagtctatccagatagagtgcctattacaacagcagggagcctcttttgtatgtataaagttcactttggttctcatatctaaacccttcaggtcagaatacaacagaaaaggttttgatttctgtcagtttcattttctgttaagctttttaaagtacatattaaatatatagtagttaaaacttttaaataaaaaacaggtaagtgtacagggaaggaaaaaacctagtttggaaatcttcctcaggccatatgtttatgtgattataaatttgaaaattaccaggaatttaaaaattctcatgtatttgaaattaaaagggtaaatacaagcatgggacttttagtaatattattcaaaatttatttcaaatatattattactagttatttagtagattttctttaaatgttgtgtttgctcatattatttataagttattatttgtttaactttataatagtctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaacacataccctacatgttgaaatcattatttgttagttccaggcattgtacattgctcctgactttttccttttttaactggtagagaagcatgaaaacagagctttccagataataaaagaaagaacaggggctttggagtcagagataccaagcttcaaatctctactctctgccactcactagctgtgtgaccatggggaaggtacttaactctctgtgcttcatcgttcttagtaataaaatggagataataatagtagtattttcctcatgaggttgttgtatggattaaatgagttaatatatggaaagtataatcactttcctggtacataaaaagcattcactaataatagcaagctagcatgctcactaaaggttagatattattgtaaatgctattgtacatcatgattctccgttacatcatgattaaaatcaccttggggcacacattttattctaagatatccttagttcagtaatagtgactgtagttaacatttgcaatgaaataggtttaggagagatccttgagccttgctctaaaggttatccatcccactaggccctgccaaggcatagtgagaaggcttatattatagcaagagaggccctttcctaggaaatgcatagttccctatagacaggatttgggggaagcactgtaggaatgcctgactgtccttagttgccttgggtgtgcccagacttagagctgatttttaagggtaggaagctcatataaagttcaagatttgtatccacagtgatatttactgagtgactatgatatgcgcagtgctatgcagaacacttaaaagctagcaggaagcattaccagagtgaaaaagcccatggctattgtaaagacacttcattgtctaccacgaaaataatctcttcactttgtatacttacatatatctcttggagatgactttatcttaaacacatgcctaagacatttaaaaatagatttggtggtagtttcaacgtaatatatggcaaacactctctacttctttccttatcagtttcactattttgtgttgtttcgttgaattgagacaacagaagattttctccccttgcagccagatagtgtaagacttgttcccacaatattgattactgtataaatggaaaggtaatgaaaagtcagactttctgtgcaacatgcagttttctaccttattctgcctctgaaaactgggccaaagaatgctagcgacaaaccactacaggtggctggactcctgatgtttgttatgtatcatattttagtagttccccacaggcaacagacataataagcagttctggcttttaaaatatatttattgttttctcagtttgtgaaaataaaaattaaaaatattcttttcccttgccaaagaacaaaatctgcttaagggcaaaggcaatttgaagaggagtttggcaatatcttccaatattttaaatgtatgtgtccttggacccaacaatttcacatttaacattttatcttgtagatgtacacatataaatgtatatgtttaaagttgttcactgccacaaaatttatatagcaaaaacctggaagcagtctaaatgtccatatggttaaagaaatggcggtattacccatataatggatataaccacctagacattaaaaagcatgagagatttgtaagtgtccatatgaatctatcaagatgtatatttttttcttttctttttattttattttatttttttttagacagagtcttgctctgtcacccaggctggagtgcattggtgccatcttggcttactgcaacctccgcctcctgggtttaagcaattctcccacctcagcctccctaatagctgggattacagtcgctcaccaccacacctggctaatttttgtatttttagtagagctggggttccaccatgttggccaggatggtctcgaactcctaacctcaagtgatccacccacctcagcctcccaaagtgctgggattacaggcctgagccaccacgcctggccgcttttaatttttttcgagacagggtctggctctgtcgcccaggctggagtgctgtggcacgatcacagctcacggcagccttgacctcctgtgctcaagcgatcctcccacctcagcctcttgagtagctgggactacaggtgtgcaccaccacacctggcttatttttgtttcttgtggggtttttgtgtgtgtgtgtgtggagacggggtctcactatgttgcccaggctggtctcaaactcctgggttcaagcaatcctcctgtcttagcctcctgaataggtgggactacaggtgtgttaccaccataccccagctaatttttttatgtttcttagagacagggtcttgctatgttgcccaagctggtctcaatctcctgcgctcaagcaatcctcctgtcttggcctcccaagccctcagattacaggcatgaaccactgcaactggccccatgtaaatcttttaactaagcaatttcttttctaggaatttatcctaaggaaaaaatcagaaaaaaaatgcacacagttttaaatacaaggatgttcatcagaacattatttacaacagcaaaaagttggaaaacagcctgtctccactaatgagagaatggtccaataagtcatgtttatccatacagccattaaaagtaatgtcagtgactatagtataaactattggccagacatggtggctcatgcctataatcccaacactagggggctgaggcaggaggatcacttgtgcccaggagttccaagctagcctcagcaacacagggagacctcatttctacaaaaaaatttaaaaattagccaggtatggtagtgcatgtctatggtcccagctacacgggaagctgaagtgggaggatcacttgagcccaggaggctgaggctgcagtgagacatgatcacaccactgcacttgagcctgggcaacagagcgagactccatctcaaaaataaataaataaactatgatacctgtgtttttattgaggtgtaattcacataatgcacaatcaaaactgtttagtctgacctcaattttctgaatacataggcatagaagaaagatgagaaggaaatatataaaaatgtgaataatgatcattgctgggtagtaggattacagtaatttttttttttttttttttttttttggagacagagtttcactttgtcgcccagactggagttcagtggcgcgatctcggctcactgcaacctccgcctcccaagctcaagtgattctcctgcctcagcctcctgagtagctgggactacaggctcatgccaccccgcctggctaatttttgtgtttttagtagagacaaggtttcaccatgttggccaggctggtctcaaacccctgacctcaagtgatccgcccgcctcggcctcttaaaatgctgggattacaggcatgagccaccgtgcctggccaattacagtaatttttaatttcttcgtatgtttctgtagtctccaaatagatttctgtaacttctttataatcagaagtaagtgatttttaaaaagaagaatgaagacgccctttattggaaacacaattataatggcaatgttcctcacttggtctcaaagaagttagtaggttaccttatctccttttcccttccactgaataaaataaaaaataaaataaaataaataaataaaaactttcttattttataggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattttctttagttaatggttttttgaaataaacttgaaataagcatatatttctcagatatggatttcttgtatattttgggatttttaataaaaaagagaaatgccaaaacttcttttgattattgcattctggaaacactctcatttttcttctattgtgatataggtcaatgctggtccattagcatatgcaagagctttcttaaatgacagccaagctagcaagtatccacctaagaaagtgagtgagttgaaagacatgtttaggtaagtgttttatagttttcaggttagacccgtgttcgttttctctattttcttcttttaaaaaacaacaaagtattgaccaaataatacccttccaaaaagggacattctctgtggtcttttacaatatctaagtgacctcctaatggcactttgagcaaatgtgagatcagtttcatcctgcaggacattaacaataccctagtgacccaagagattaaatatgccagtttactatattgctttgaatattttaagtgacacaaacacaagcctatgttccttatgtgctttccttcttcacccaattgacctcctgttacagcatttcagaccatttggggtaggaatagaagtggggcaggaaagattgcataggctcactccagtcccctgtccttacttctacttggactctgccaaactagggcatgcaacatcttgtcttcagtgagcggctctgtaagcttaggcatgtatgaatgctcctacattagagaaatatctttaatatataaaagtcttcattcagaagaagagaaacagttgagtaatatggactaaggagaaagatgataatctatccactcatttgctcccgacttattttgtttacttttcctgtctatgttttatcagctgttccagagtgcagagtaaccagtagtcattcattcaccagtattaatgcctggtacatgcaaaagactatttgttgctatgacagggatataaaacaaatggacaatgaagtactttgtcccctaagacctacactctaattgtggacattaaacataaacacatgaaataatggaaaaagacttttatgataggtcatcaactttctgttctccttcctagcagcccagggaagatccttcatacctgtaccacccagcactgtactagccacatagtaagctcaaaataaattctttttgaatgaatgactcgttatttataggtgcaaattaatgtcagcacaactttagctgatagaatgccaaggaaatgattgagcaagtaggctttccagagggtatgtgttttgagccaagtcttgaaggagataagaaatgaaaccataaggcaaaggtggaaaggaaagaaggcatttcagacttaggaagagacattaagaaataaatgcacagtgagaaaatagaggattctgatcttcttcctaggcaagccatggctaaactgagttatcaaatggattgtcagtgatacttcctaagaataaataacaagacctttatctttgatattcatccacaggaaatttatacaagcatgcagcattgcacttgaactaaatgagcggctaattaaagaagatcaagttgagtaccatgaagggctaaagtcaaatttcagagacatggtaaaagaattatctgacattatccatgagcaggcaagtattagggtgactaaaactgaaaacatgatctgcgggtcccaaaattgttgcttagcaaaatataatggttcaaaatgcacaaccttaaagttattaagtctatattttaaacttttttcatattatctttaatcatttaagtgatacaatacaaatcaaatttgcaacaattatctaaagtggttagtgatgcagttatctgtaagaaaccattttgttttttgtgctccagtgtcagaggcaagaggttgaactgaggtataccgttatcaaatagattacatagtttgtttttagaaactatctagttgatgagtttctattcctcataatgcatagaaaaagcagcaaaaattcctccttcacaaaagatatgacaattgcacatgctattttaagtgagtatctactatattacagttatttcatttgcatgcagctgcatgacctagtgttgaactctaaattattcaaattgaaaacaaattattcaatgtactgttattactgtaatcaagatattctgagtggtcattttataaaattttgttttccttttgaagcatggatttttcaaatctactgtcgtatttcccacttgtctgtatcagttattcccataaaacatggctatttctcttagatatagagaccaataatttagactcttaatattgtatattgatagctaaccaagaaaactcttagtttctattggcttatatttatgcaagccatcctgtcattatgaaacatatttgggtgtgccttacttttggcaaatgttgactttgtagtgaattgagtttcacataaaagagagccaccttgtagtcatacactttgaggcatatattaatactgagaagtaagacaagtgttaatgtgtactgaaatttgaaatattctcttgagctccataaatgattacttgacaaaaagacatgactggatattccttgtcccctttcagtgtaatctgttacagaataccgaagtatatagtcctttcaaaaacttcttcaagcttttttttcttttttttttcttttttttttttttttttgagagggagtctcactctgtcgcccaggctggagtgcagtggcacaatgtcagctcactgcaacctccgcctcccggattcaagtgatttctcctgcctcagcctcccaagtagctgggactacaggcacgtgccaccacgcctggctaatttttttgtatttttagtagagatggggatttcaccatgttagccaggatggtgtcgatctcctgacctcgtaatccacccgcctcggcctccaaaagtggtgggattacaggcgtgagccaccacgcctggctgcttttgatttttaaaaggatttatattatcataaagctataaattacagatttctcagatagagttgggggtggtcattgtagcatctgttgggtatgttttgtaatttcttagcaataagtaccctccttgcctgtcacatctgaccagcatagataatcagttattcatctcttaacattctagtatgctttcagattagtgtcatgagttaatatttttgtaagaggaaatttctctattataaattttatttaagccttatgatttgtagcaacacaaatgatatgtctcaatactgccactatagatcaatctgtgggcttaatactgaagtttcacaactaacttgagaaccaagtattgaaagcttgggacctaagttaggactttatggtaaagagagtggatataatgtatatagcgttttttacctcaatctactttaagcacaagatttctgttgctttttctttagattacacaaaatggatcatttaaaaaatatttaaactaatacgaatatctatgtttatatacttactggaatacaatctttaaattttatatttatgaagttcttcctttccaagaaaaatcttctgtatcaattagcttatacaattataatgtgtctttagaaatatgcacttaagacttttatcttcatttactattattttcaagtctccagggaaggaacataggtatctgcatgtttcaaaagtcccatagatgattctgagaaccactgtgttagatcattcataaactcatgtcagagtctaccatttagagctcttgttatgaccatctgttaaaaaatattttaaagattgtgttacctctcgctttttattgaattttgcattttacagtctttgtttttcttaatgagtaactagatcttttctgcttttttgatatgctgcctttgtaatacagctttgaagacttaagtcggtaatgttattctttgctctctctgctttctgtctttttaaataactgtcagtgataaattgaaatatgcctgcaatttcatatacacattctttttttggcagtggctattttgcttcatgataatcatgctgatttcttctgttttagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaa

SEQ ID NO: 5856 - DNA, 3178 bp, human; identical to SEQ ID NO: 3651

SEQ ID NO: 5857 - DNA, 18330 bp, human
gggtcgtaggggaccgcctggggatccccggacggctgcgaggaatgagcggttggctcgggctggtttcctccctccaccgcctgcttgtttcgccatgcccgggccggacggtggggctgcagcggcgaaagcgactgaagtccgggagcagtcgcatgagcttcccggtcaccaggaggccccgggaacagacacctcaccctgacattgtggcaggtttggcccttcccgcaatgcaacaaaggagggactttgtcccagcctttcccctagccaggagaggtgctgttaaatccctttgtgcctccccaccggccttggagagatgagatttcccctgtagtaccccaggggacgggccgacgggatggactttgtatcttttggctgatctggccggacatccttgcccaataagcacttacccagttgcccaccctccaaaaaaaggagaaaatcaaatcagtaatttgatcgatcattttcatagatatgctgtaatagaacaattcacctggttgtgaactgggctggggagtttcaagacgtgagtttgttaactgactagtttcttgcttggtgtagaggccttaggcactctcacacttaaaccagcagaaaggccagggagtatctagactacacactggggtcactcaactggaaacacgttgtacacctcaagacatcgtacaatttctcagactgagatgctggctgtgatgtctatgcagcacagccccaagtcccaactgacagaaatgtctcagaaacttaattcaccacggtctttttttttttttttttgagacagagtcttgctctgtcgcccaggctggagtgcaatggcgcgatctcggctcactgcaacctctgtctcctgggttcaagcaattctcccgcctcagcctcctgagtagctgggattacaggcgcccgccacgacacccggctagtttttgtattttttagtagatatggggtttcaccatgttcgccaggctagtcttgaactcctgacctcaagtaatccgcccatcttggcctctcaaagtgctgggattacaggcgtgagccacatgcctggcctcaccacggttttatttttgtttttgtttttttttgtttttgtttttgttttttcttgagacggtctcactctgtcgcccaggctggagtgcagtggcacgatctcggctcactgcaacctctgcctcctgggttcaatcagttctcctgtctccaactcccgagtagctggaattacaggcatgccaccaccatgcccagctaatttttgtatttttagtagagacggggtttcaccatgttggctaggctggtctcgaactcctgaccacaggtgatctacccgccttggcctcccaaagtgctgggattacaggcgtgaaccactaccagcagcctcaccacagttcttaatagaagtagtctatttgaggaaaaacagttaatttataaagaaactgaataatgtaataaattgaggaattttttcccagccttgtactttttataccatcaaatccactgactttaagtgtacagtttaaaaaataaatttagccaggagcggtagtgcacacctgtagtcccagctacttgggggctgaggtgggaggatcacttgagccagggaggttgaggctgcagtgagctgtgattgtgccactgcactccagtctgggtgacagagcaagaccctgtctcaaaactaaacaaataaataaaaataaatttatggagttgtgcaaccatcaccacaatacagttttaggacattttccctatcccccacgaattcccagaagcagtttgcagttaatctcctctctcatgtttagccctaggcaaccatttgtctgctttctgtctgtatatagttgctttttctggacatttcacatgaatggactcatacaatatgtggccttttgtgtctgggttctttcacttaacatgatgttttcaaggttcatccattttgtaacattatcaatactcccttcctttttctggctaaataatattacattgatggatataccatattttgtttttccactcatcagttgataaacatttgagttgtttccactttttggttgttatgaataattctgtgaatattcgtatacaagtttttgtgtggacatgttttgggttctcttgggtatatacctaggagtggaattgctgggttttataaagtaactgtatgtttaactttttaggaacttctggattgctttccaaagtggctgcactgttttctatccccactggtaaatgtatgaggatttctatttctccacatccttaccaatactttcttgtctgtctttttgattagtgtctcattgtgatgttaatttgcctagattgagtgacttttggttgtatttggtttagctagtttcacttcatttaatgaatgccttttttagtgttataaaaattaggagctgaaatgaataatacatagtccttccttgcaaggagctcatagttccttcaggaagacagacaacaaaacaatgacagtatagcttgttaagtgctctgaagggagttgaggacaagatgctctggggagcagagaagaggaacacttaaccctgcttgaaggcgggtggaggaaagtattaaggaaaccttttacagaagaggaacacttaaccctgcttgaaggcgggtggaggaaagtattaaggaaaccttttccagaagaggacttaatgtgcctctcgttttcttttgtttattttaatcaaaattatacaagtacatactgtaggttttttatttgttttgaaacagcatctcgctctgtcacccaggttggagtacagtggcgcgtgcaatcacagctcactgcagcctcaaccttcaagcaatcttctcacctcagcctcccaaatacctgggactacaggtgcacaccaccatggctggctaatttttaaatgttgtgtagagacagggtttcacagccaggcgcagtggctcacgcctgtaatcccagcactttgggaggctgaggtggacagatcacctgaggtcaggagctagagaccagcctggcaaacatggcgaaacctcatctctactaaaaatacaaaaattagctgggcgtggtggcatgcacctgtaatcccagctactcaggaggctgaggcaggagaatcgtttgaacccaggaggtggaggttgcaatgagctgagatcgcatcactgcattccagcctgggtgacagagcaagactccatctcaaaaaaaaaaaaaaaaaaagaaaaagacaaaaaaaagacagggttttgccatgttgcccaggctgatcttgaactcctaggctcaagcgatcctcccatctcagcctcccaaagtgctaggattacaggtatcatactgtagtttttaaaaatcaaatagttctacaagatttgctttttttaaaaaatgaatcatttgctttccttcccattccatgttgcccccaaaagcaaccactttctattcttttaagtctttgaatatttacctgtatatctttaaagagcatatttatatttgagaaaaagaagccccaacataggccaattaatatcctcacttgcactgatttttaaattggtcagccctattaaatattaacacatagttagttatgaaagtgacggtcacaatgcagcctaccttctgtccatctaaatgaaagaagacaggcatgctcaacagttagctactagaataactgaagtaacacaatacatacttttaaaaaatgtgggctgggcgcggtggttcacgcctgtaatcccagcactttgggaggccgaggtgtgtggatcacctgaggtcaggagttggagaccagcctggccaacataggcgaaacaccatctctactaaaaatacaaaaagtagccaggcgtgtgcctgtagtcccagctacttgggaggctgaggcaggagaatcgcttgaacctgggaggtggaggttgcagtgagctgagatcacaccactgcactccagcctgggcgacaaaaaaaaaaaaaaaaaagtggctgaggaattgtttttctcattggtgctttactatcatatagctccaataagccagcacccaaatgtaactgtcaattatgaggaatgttattttcacttaaactttaaaagaaaagcaaaccacaaacaagctgcatgatgtagtataggaattagcaatctatgacctgtgagctaagaatgtgttttcagatgaatagtgacaacaaatttgatgatagggaacactaattttcaaccctaatgaagcaaaatattatttttctattctaaccttttcattagtagaactgtattataaaaccttatagtcaattgttattactttttaaatttcattaattaaaaatttgtacaattttgttttctctcattatgtaaatacttatataatatcctcgatcttgcttcttggttcataaattctaaattattaattctctgaccttcacagaaaagcttgctaactcctggtttaatagaataaaaagggctgggcgcggtgactcacgcctgtaatcctagcactttgggaggctgaggtgggcggatcacgaggtcaagagattgagaccatcctggccaacatggtgatcaaaagatcgagaccatcctggccaacatggtgaaaccccgtctctgctaaaaatacaaaaattagctgggcatggtggcgtgcacctgtagtcccagctacttaggagactgaggcaggagaattgcttgaacccgggaggcagaggttgcagtgagctgagattgtaccactcgcagtgagctgagattgtaccactctaccccagcctggcaacagaacgagactccatctcaaaaaaaaaaaaaaaaaaaaaaaggtatggaaagcaattgacatgtacttgctgtgtgaccttgggaagtcactttatgtctctggtctttatttttattatctataaaatggagctaaagggtaatgggttgatgagataaactctaccatgaatcccccagtttttgattaattaattatacaagtatttattgagttactgttatgtaccaagaactgttaaatgcattgggaatacagcatgaaacaaaatttttgtcctgaaagaagacactgttctcaatgaaaagagacttaagatgcagtgtgtggtctgagattggatcatgatttaaacaaacttgcttaatgggacatttttgggaaaattagggaaatttgtatatggatggttattagatgatgtgaaaactttttaagatgaaatggtggaggtcattaactgaaaagggcagttgtaaaacattttgtacagtatttcatttttggaagaaaatgcgtatatgtattacatatacttagaaaaaatatctgaaaagatatatactaagctgttaatggtgatttctgtgtgatgggaacacaatgttctatttagttatttttgctttcaaatttttcacaatgaatatacactgcttttgtaaaaataaaagattgtttctaatttaaaaaataatctctcttttcacaaagcttatagctaatgcctcttgtaagtattcatattgccaatttgtcacttttttttttttcagggcaggaaaacatctaagaaaggaggctccccccttcccttgcaggtaacaaagtatcggggtgatctctgtgaaatagctactgaatgtaaactgatgctactggcattcctctgggacttttactgataagtagagctttcatagtcttcccaatttcagatgactcgagattgaatttctttttctttccttccttccttccttccttccttccttccttccttccttccttccttccttcctctctctctctttctttttttttttttgaccgagtctcgctctgtcgcccaggctggagtgcagtggcacgatctcggctcactacaacctctgcctcccaggttcaaacgattctcctgcctcagcctcccgagtagctaggattataggcacccaccatcgtgcctggataatttttgtatttttagtagagatgaggtttcaccatgttggccaggctggtcttgaactcctgacctcaggtgatctgcccgccttggcctcccaaagtgttgggattacaggcatgagccactgcacctggtctagattggatttcttatcttgcaaagccaaggtgaagtccagaccatgaaaaagcagaaaatgtatcaagataaatactaccttgtgagccctatcaatagtcctaccaatagctttctgatattggaggctttcaaatgagattttttttttttagggttaccagcaattaaaaagaagtactagagaggcaaatatcggcagtatacatctaagcgctggtcggaaaagaaggaactcagcccaagaacttgcccaatctgatactggaggtaggtgtatctctgttgcatccatgaacgcatcaggctaccaaagcccgatgtgattaagcatttgaatcgtgtaactgcttctcttattgtaggccaggagtcagcaaacttcagcatgtggaccaaatctggtctgccatctatttttgtaaataaagttttattgtttatttgtttatgtattgtctattactgcttttaccctgtgatggcagagttgagtagttggcaacagatactgtatatgacctacaaagccacaaatatttactatctgtccatttatttatttatttattcattcattcattcatgagacaaggtctcgctctgtcacccaggctggagtgcagtggagtgatcacggctcactgcagccttgaactcctgggctcaagcaatctacccacctcatcctcccaagtagctgggactacaggtgcgccccaccatgctcagctaattttaaaatattttgtagagatggggtcttactgtatttcccaggctggtctcaaactcctgggctcaagcgatccacccgcctcagcctcccaaagtgctgggattacaggtgtgagccaccatgcccagcctatatggccctttaaataaaaagtttgtggacccttcttctagattcaccagaaaactgcctcagtacgcatgcctgtgggagagaataaccacttatattattttcttttttttccctatacatttaagtagtgttcctttcatccaacggaaaatgaagaaagggactttctttggtccctgcctgtgttcacctttgccaaggacctttctctcatgaatccctctctgctcttttcaaggagggtttcaggttctgtgttatcacccaaattgtgacctttacaaagccccgctggtctgcttggaatttcacatgatgtgcccttctctagatttaggtctttacatgtagtacttgcttatttaaattttatttgcctttcaaggtgccactcaagaaccactccctccaagatgttttcctggatttcctcagcctaaagtaatccctctttttcctgggtgagttatatcttttagtttatttctcttgttaggctcacgttcactgatttacatccatactcattgctttgtgcttatttgtatttgtgagttacattctctaccagattttaaattccttgagggtaggtacatatgttgttcaactttttttttttttttttgagacagattctcgctctgttgcccaggctggagtgcagtgcacgatctcagctcactgcaacctccactccccgggttcaaacaattctcgtgcctcagccccccgagtagctgggattatgggtgcatgtcaccacgcctggctaatttttttttaacagtttcttcatgttggccaggctggtctcaaactcctgacctcaagtgatctgcccgccttggcctcccaagatgctgggattacaggtgtgagccactgcgcccggccttttgttcaactttaaataaattattttttccccatcatcagatgcaaaagaggttcaacaataaaataaattggtaagttcccccatatacttcagatctaatctttagttctccaatgtttccactgaggatttttcctgtgaaatgctggagtcacttcctttgtccgtagtgatccttgtaatttcaagcaccaggctatgattttctattccattgctttgatggagttacttccactagggggagctccttactttgctatatagtcaatttccttctctttaggagacaaaagaagggagacttcctcagacaaaatgtcaaaacaatggtaggaagtagcaactaaaaacatctcctggggcttgactaggtctcagcactagctggctcctcaaatgccatttcacttgtcatattgcaatttggtataattctggcccatgtgtcaagatttccccctacccaatctacttcattcattccatttacaaatacatattgagtacatactttgtgtcaggtattgctgtagatgctggggcttcatctgtgaataaaacagaccaagtccctgactttatggagcttatattcacatatgggcagcggacaataagtgagatgaataaagaaaatatacagtctagtagatagtctagtagatagatatttatctagtagataaatataaaagaaaaaagcaatgcagcatcttgtaggctattgtgagaattttgaatgtgatgggaagcattggggaattttgagtaggggagtgatgtgatctgacttacattttataaggattgctgtggttgttttgtggaaagtaattttttttttttttgagacggagtttcgctctgttgcccaggctggagtgcagtggtgcgatcttggctcactgcaagctccacctcccgggttcacgccattctcctgcctcagcctcccgagtagctgggactacaggcacccaccactacgcccggctaattttttgtatttttagtagagacggggtttcaccgtgttagccaggatggtctccatctcctgacctcgtgatctgcctgcctcggcctcccaaagtgctgggattgcaggcgtgagccaccgcgcccagcctgtggaaagtaaattttaagggggcaagcttgggtcaggggaggaacagtggacttggggagaagttgttggattttggatacattttgaaggtagagccaactggatttgctaacagatcagatgtaggatgtaagaggaatcaaggaaagcagggtcaccatatggcataacactaatagcattgacaaaaatgtgactggtgccccctggagttctgtaacacagcatctctgtccaagatgatgccaagtcttttggcctgaatggtcggaaagatagagttgccactaactgcaatggtgaagactgtcagatgaacagggttgggagtgtgttggaagctcaattttggatatgtttaatttgagctgccagttagacatctaagtggggatgttgaataagctgtgggatgtatgaacctggcattcagaggagtggcctgggccaaagataaacatttttgagtcgtaggcatctacatagtatttaaggtatgatatggacgaaatcaccaaggagtgagaagggttaaagagaaggagaccaaggaccaagccctgagacatctcaacatttagagtttaggaacgtaaagaggaacaaataatggaggctaagaaagactggccagaaggtagaaggcaaaccagaagagaatggtatcctggaagccaagtgaagaaggtgcttcaaagaagagagaatgatcaactgtgaaaaatacttatggttggccaagtaagctgaggtctgggaagttttggtagaatttaacaacttagaggtcactagtagccttgataaaagctgtttcagtggacaaaagcttgattagaatggttcaaaagggaaagagaagagaaaaattgtagacagggagtatagacaaatcttttgaagatttttgttttaaaggtgagcagagaaatgaggcagtaactcaaatggtttgtggggtcaagagagggtgttttgagtgggagaaataattgcaagtttgctctaggagtacttagcgacagttgagttcacttgtacttattcacctgcatttcttgggggtagtacccagtaatcctcagggaaggtagctatcacaggaggggatgttgccaataggtttgagtggaatgaactctaagggaacccatggatgccctttaataaaactgaattcagaacctctgcagttagcagagcagagagtatcttaatgtatggaaaaaatcagggctgtgaggtctagctatccctctcacccacatggtgattccagcctcctttgccaaccttgaaagatctggcctcaagttacactaaagagagtctgagggtctccttccagaaacattatctattgtatggaagggagaggaaaggaagttcttacaggtgctgtgaagctgactaaaaccccagggagtgtttcaactaagtgggaaacttgacataaagattcactggtcatttcccggttccttggtgagaagtggcctcagcagtagaagacagtatagcactgggcttgtttcttagctttgtactttagtagtgatggctttgaaaacacatacaagttttactggtctccatgtagcattttggtttgaatttttttaaattacttttatgtttttgagacacagtctcactctgtcacccaggctggagtgcagtggtgtgatcttggctcgctgcaacctccacctcccgaattcaagcagttctcctgcctcagcttcccgagtagctgggactacaggcacctgctaccacgcctggctgagttttgtatttttagtagagatgggattttaccatgttggccaggctggtctcaaactcctgacctcaagcaacctgcctgcctcagcctcccaaagtgctgggattacaggtgtgagccactgtgcctggcctgaatttctttcctattctcataccttcaaggcccagctcatatgttacctgctctacagagccttctttgagctccctctctggcaaaaataatcatttcctctctgcatctatagtattttttctctttctttctcttagcacatatcacattgcgttatggttgtgtggttgtaaactgatgaggcagtagagtgtaatgatgagagcatgggttctggagctaggctgcttgtattcaaatggtggctcttgcaagttgcttaacctccctgagcctcagtttcttatctgtctcatctcagtttaataataacaatatgactgggatctcataatagggattttgtaaagattaaagagattaacaatgtgaagtacttagaacagtgcccagcacatagtaagtgcttagtgacctttcgttatttgtttctcttcttgctgaggaataagaccatatatatatatttttttttatatggagtctcactgcttgcccaggctggagtgcagtggcgcgatctgggctcactgcaagctccatctcccgggttcacaccattcttctgcctcagcctcccgagcagctgggactacaggcgcccgccaccactcccagctaattttttttttgtatttttagtagagacggggtttcactgtgttagccaggatggtctcgatctcctgacctcgtgatccacccgcctcggcctcccaaagtgctgggattacaggcgtgagccaccgcgccccgccaaataagaccatatttttatcttttatatatatatatatatttattatactttaagttctagagtacatgtgcacaatgtgcaggtttgttacatatgtatacatgtgccatgttggtgtgctgcacccattaactcgtcatttacattaggtacatctcctaaagctatccctccccctccccacaccccacaaaaggccccggtgtgtgatgttccctttcctgtgtctaagtgttctcattgttcaatataaacagaaccaaataccatatttttatctttgtaccactgatgcttagcactgggcttggcagagagtactgggtatctacttaatcaatttttgtgtgaataaaccagatttctaaatcaacttcagttcttctttaatagtttcataggtatatagcccttttatgagatcactcattcattcctgtgtaccactctgtgtagtagttaagaatgaaggttctggagcctgatcacccagtttgtattgttgttttgccagttattggctggatgagattaggcatgatatttaacatctcagtgcctcagctctctcacctggaaaatgaggagaaatataggacgttaaacatagagtttctgaacactcaaaagttaactataagtattattaatcttatcagcaattaagcgacttaatgaacacctacaatgttccaggaattgtgctaacagtggggatgcagagatgaataaggcttggtccctgctctcagaaatcctataagctagtgaaggaaacaagtgtgatcaaatcagtatgtatggagcctagcagaagatgggatcaatttaacaggagggaacagtaacaggaaaaggcagggtagtaagactttatagaggagggaattcctgagctttgcatctgtgggttgacagtcctgggatattaatgtcaagtacatattgaaatcccttttgtggtttatcagagatgagttttataacagatttctcccatcagattttcttttttgtttgtttgtttttgtttcactgaaagcatttacctggaagattttcttaataaggccacttaacaagaggcctccagacggtgatgatctctgtcctcacttggcagcatggtgactgcactgccatgcagctcctccgtctcaccttgccttttgagagatctggctggttttaggagcactgttactggattcaacattgcatctagacttgagaattctttgttcacatctggtttgaaaaagaatgtttgaatggcttctgtctgtcctgtttgcttggaaacagaaacagggctaattgttttatggaaccctcaatctgctatttgaatgaattttatgataaatgcatataaccaagaccagtattgatattgccttctagtttgggggcctaagaaaaattttaatccttctcagaaaatatggaattgtcatgtcaataaatcttgtccaatgcctaaagaaaaagcctcaccctggctgggtgtggtggctcacgcctgtattcccagcactttgggaggctgaggtgggtggatcacgaggtcaggagttcaagaccagcctggccaagatggtgaaaccccgtctctactaaaaatacaaaaaaaaaaaaaaaattagccaggagtggtggtgagcacttgtaatcccagctactcaggaggctgaggcagagaactgcttgaacccgggaggcggaggttgcagtgagctgagatcacgccattgcactccagcctgggtgacagagtgagactccgtctcaaaaaaaaaaaagcttcaccctgccttttgaatcccagagaacctgttctgggccaacaatgcaccaccaggctttcccaagtgcaccaaacatagttttgaatagttttccttgggcaaagctcctctttccttttgaacttcagccagagggccctcacaggcagaagactaaatttcagatgcttctgtcttgccctctccctccctctcaataaattttctgaaaaagttggcatttggattcttcttttcccaccctaacaatcaggcaggaaggaagtagagaatagcatatgttctaagaaaaggctggtgcccctttctagctcacccttttaatagaggcctcttagagatggtgggactggagctacaattaaatttttgagatcaaagacagggtgcagatagatgaaaatcttaatgtcttttgtctctcagaaaaccaatagagccatcgaagcttgtctagttcccccaagtagttaatgagaacaatagaattttgagttcctggtgttctttggagctgattttggcaaatgacaagcagtttgtaaaagggcttattattcgagtagagctttggctgcctgacttttaaggttgattatttgttttgcatgttgtataacaggagtgttgggcaatgctcagaagaggtttttggggtcagagatgtaaggacttctctgactgtcttctcccaacagaaccagattccagctgcggagcaagaggcaagcttgtacacaggaccaaagccatggcttttgtatagccccttaccaccagacaggccttttcactggttcctttagggggagaatatatcaaaatttctatcaagtcagtaacccaagaaaaatatttctctgtgtatgtaatttctcaaactttcattggtgatgtgacctgctttttaaagaaacatttttaaggacatagtttggtcttttgcaataaacagttgtatatggggtccctgtcagctcagtaagtagatgctctgaaaggtagagccttcaactggttatagtgaaaaacagctaagagaggtcttccctcattggtgaagagtgccaagtggatgttgtcccagcccttttgttttcaaggtttaaagtgttgtgcttcctgaccaggtgcagtggctcacacctgtaatcccagagctttgggagaatgaggcaggtggatcacttgaggtcaggagttcgagaccagcctggacaacatggcaaaaccctgtctccaccaaaaatacaaaaaaaaaattagccaggcgtggtggtgcacgcctgtaatcccagctactggggaggctaaggcaggagaatctcttgaacccgggggacggaggttgcagtgaatggaaatcgtgccactgcactccagtctgggtgacagagtgagactctgtctcaaaaaataaaaataaaaaaataaatgaaatgttgtgcttcctatcttatgctggacctgctggctcactgagagatagagaggcaaatattagacattttggagacagtgaatgaaggatgttcctctccctcctattctaaactttaaaagtacactgagccagggcctacaagaaattgagattttttttttttttttgagatggaatcttgctatgttgccaaagctggacttgaatttcaaacaatcctcctgcttcagcctcccaagtagctgggactacaggtgcttgccactatcagatggctttgataaacagaaacttagttgtgtctccttttttgttttttaatgggaacctaatatatgagggagttctgtgtataaaggctataaactagcatttgtgtccagtgccatcagtaaaatgggaagtagcagaaggagatgataggtacctaggaagagatttcatgagctattcaataaattttggatgctttttgatatttggaagatgtgtgtccttaggagagatggcctctacacttgaagttactaattcatggcaaaccattctccttcaaagacaaagttttgctgaagagagtcttgggaaacatgaaatctgatcatcctggtagagtttgtgtctctaaaaggaactatacattgtgggtgtgagtagcttaatttcttgcactaaagtctctggcaccctaaatgaaacactgctttggtgcctatattaatcacgataggctagaccgatacagtgacaaatagcagaggtttatttgttgctcacataatgtttgatatagactggttggtcctcttctgtcttgtagctataccatctggaacagatgacttccaaggacaccgtagcaaagaaaaagagaactggaagcccatgtgccttaatcgcttcatcctagaggtaacacagaacttctgcatacatttcattggcaggaactaatcacctaaccccaatttaaccacaaggaagactgggatatgtagaggcatagctagtagatttcacgtctattaacagtctctgctataccccctcagtaccaactgaccactaacttcccaccccactcaccaggaatgtatagctgctgatgattttcgaattcggtaagagactggattgtgaatatcagaccacctcttcagtctaacagacagtgcttgttttacctaaggtgaggagacagcacaggcagtactcacttgtttgtcagttacagtccttttcctctccctctctcattactcaccatgaaacacacattgtcccttctacttctgtcccaagcgtcacactcataagaacataagaagtgcccccagatcaaacaagagtgcttgaatagaaagtgagatatttcttctttataaggttgaccttacaaggctgaggcaggctatgcctaattatgtagggaccctaatgtctcatggttgtgtcagcataaattaattaatgattaaccctctaacaaggctaagtgaacagaattccccagtgtcctgagagaaggaaagttaatgtgttctttctcccaggaggaggataaccagtggagccttttctggatttctcactagaagtaaagaccaaatttccagaaggaacctgagagataaaaagtggttggctgctcctgacctgactcatagtgtttaactgaaccataccactagtgtatactagtgtgtgtgtatgtacatgcatacacacatgcacacacacattcacacacaatcctatggtatttggtgactttggatgcccagctcttgcaacaatttcctgctgtcattcttttccctttgaatctcaggggtgagcaaactaaagaaatactatcatcttactgcttttagtatattccatagaaaaggagtggctggagtcagtgtagatcaacccaagcagtacaaatctgccagaattgcagctcagcttccttacctccagcatgtgtacctttctgaagggtaggcccttaagccagacataagtaagttatccactctgtgcataactgtctgacttggcttagaagcatgaaaggggcagaaatgtaagatgggtaaagaagggcttcatctgaaatagggccatgatgattagctctctctttccttcctttggcttcattgctgtattccatgtgggtcttgatatcttgaaactggatgagatacccaaatagtcagtccctgaatataaatcatttccttgtacagaatcactgccaaactcagtatggttaaaagatttttaacacccagctgcagcattcactctggttagaattggccatttaaatttatttcacatatgtaagtatcatatcctttataatgcattcttaattgttgctcagttcttccagattgaattcctttaaaaaattccttatgtaatcttttaattctagttggaaaacatcacttgacagttgctgtttatacaggcatgcctcgttttattgtgcctggctttattgtactttgcagatactgtgtttttcacaaatggaaggtttgtggcaaccctgcgttaagcaagtctgttggcaccattttctcgacagcatgtgctaactttgtctctgtctcacattttggtaattctctcaatgtttcaaactttttcattatgattacatctgttatgtggagctgtgatcagtgatctttgatgttaacattgtaattgttttggggtgccacaactgtgcccagataagacagtgaacttaattggtaaatgttttatgtgttcagactgttccactgactagcccttcttcaaactctctcactctccttgggcctccctattccctgaaatacaacaatattgatattaagccaattaataaccctacaatgatttccaagtgtttaagtgaaaggaaagacatgtatgtttcaccttaaatcaaaagctagaaatggccaggcgtggaggctcacgcctgtaatcccagcactttgggaggccaaggcgggcggatcacaaggtcaggagatcgagaccatcctggctaacacggtgaaaccctgtctctactaaaaaatacaaaaaattagccgggcgtagtggcaggcgcctgtagtcccagctacatgggaggctgaggcaggagaatggcgtgaacctgggaggcggagcttgcagtgagccgagatcgcgccactgcattccagcctgggtgacagagcgagactccatctcaaaaaa

SEQ ID NO: 5858 - DNA, 43365 bp, human; identical to SEQ ID NO: 3652

SEQ ID NO: 5859 - DNA, 43737 bp, human; identical to SEQ ID NO: 3653

SEQ ID NO: 5860 - DNA, 48307 bp, human; identical to SEQ ID NO: 3658

SEQ ID NO: 5861 - DNA, 43179 bp, human; identical to SEQ ID NO: 3655

SEQ ID NO: 5862 - DNA, 42625 bp, human; identical to SEQ ID NO: 3654

SEQ ID NO: 5863 - DNA, 41651 bp, human; identical to SEQ ID NO: 3657

SEQ ID NO: 5864 - DNA, 41652 bp, human; identical to SEQ ID NO: 3656

SEQ ID NO: 5865 - DNA, 52783 bp, human; identical to SEQ ID NO: 4978

SEQ ID NO: 5866 - DNA, 52886 bp, human; identical to SEQ ID NO: 4980

SEQ ID NO: 5867 - DNA, 52885 bp, human; identical to SEQ ID NO: 4979

SEQ ID NO: 5868 - DNA, 43193 bp, human; identical to SEQ ID NO: 4981

SEQ ID NO: 5869 - DNA, 1509 bp, human; identical to SEQ ID NO: 4977

SEQ ID NO: 5870 - DNA, 533 bp, human
ttttttgcaccaccgcgaccagccttagagcgcggcggcggcggccacggcaacatcagcccagccatcagccgagcagacgcccagcacccgggagcgcggcgagcttcggctcagcccggagttcacctccgagtgccccgggggctgagctcaccccttctgctctctcacacacgaacactctctttcactcacacacacacacgtattcacactctctcgcacacacataggaccctgggcgcaagcacccttctggcagcggtcgtccgctggtgcaatagtagctaggttcggttcctgcctccggcggccgccggtttagagcaccgctgccagcagccggaggagagcaatgcgggggcccgagcggcagctcgaacagtaatgtggatttacagtcgtttcccgcaggagtcggccgagacgccctaagtcccgggcactggcagcgcccggcggagccgagcacctggcgagggggcgggggaacagcacctggggacgccgccgaaacttgcgcttggaat

SEQ ID NO: 5871 - DNA, 32044 bp, human
gggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctaggggtatgtgtttttgggggtggacggcgacgggggtgggggatactttccttcccgtggcggcaacctagttcgtatcttattcctacaaggtagcgtcgcttcgagtcgcatggacattggggtttagataatttaccccccacccaagcgatttaatggcttttaagcaaaaggcgaatacctggatttccatgggagggatgaggtttgaagattgggattcacccctagctcacttccactaccaacccctctttcttgtgagccacttccacgggtattcaaatctgggggggaggggggacgggagtattaatatgcttctctatttctacacagggtcggcgtggcgaaggacggctagccttggagggaaagtagccaccagtccaactcgggtcgcccccaccattatttcggtgagggggcaacgctaagaaggggatactggtgggtaggggcccagtataagggagggggctgggtagtcgtccccagaaggactccgtgtcttggcggggagagagagaggcgagccccggcttcaggggaggggttccggggagggagatgggggggtggcgacgacggtgggggggggagcgggaagaagggggagtcacgccctgcctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttgcccggcttgctgcagccactgctgcctccctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccggggcagagggcgcaggcggcgcgcggtggggagggggccgtcctgggggcgggggcaggcgggggggtggagcccccgacggggggcggtacgagccgggacgacgacgacgaggagccccgggggccgggtgcatggaggacgaggtgctgggagaaggaaggggggtgtgggtcccgcgactggcctcgtgggcttggctcctcgaggttcggtttcgggacagagccctgcaggggcgccaagaggccggggaagggatagggaggtgaactggtcggtggagggggccctcctcgccggggtcccgccgagaggaaggctgggccagagggacgtccggggcaaggctgggaggagccggccgcacctcggctggggatttcgcgttatggaggtgcgggagattgttgtagggaaagacgtggtcgaggggaaaggtgggagggaaacactgcaaacccgggaggccaacagcacaggcccgtgggggtgcccttctattccgctcgcacctcctccctccctgagtggaagcactatgtttttgttttattgttttgaaattttcaatgttggctgatcgaaactgtcgatggggtgatattcattcttggtgtctcctggagtagacagtaaagacaggcatcctttggcgagcaagcatctagcccagggtttagaggctctttacgttagtgtgggaagggggcccggtaactttgtgccacagcttgactactgttaaggcagtttggaggtcgtccctgtggtacagaggtggagtacaattgcaaaaatcttcagtaagacttctggagatgagttgtaggttagcgttacagtggttagccctgtggttctttcaacttagaaggctctttctcaaaagcacgccgttgagttacatgggaaaataaatgtggattgcatttggggttgggagtggattaggttgattataaaatttcaaggttggaagggagttttaaggttatttacttttctgttgatatgtcctgtccttgaatgttggaattgagggagctttattttggggaagatggtagatggcacagtggaggatgtctggtgcacagtttagggtactttaattgaatggtgatgtcaccatgtggtactaaagatgacagtatgtaggagagaaatttgggggattccactggggattaaatgggataacctaattttaagaatcatcccggggctccaaatagaagcaaaaggctggggaggagcctgtaaaatttcgatggaggcgaaaagttagtagcaaagattgaggtagctgggaagagcaaggggcttggtgagtcaagttaagagaatctgaaggttgatagtagagtttagggatgtggccatcttgactaagtcatgaggatgttgttaggcggacatcttttgacagggcaacttaggcaactgcccttggggcagatgtgagggatgaaaggtacaggccttggggcacagatcctgactaaaattgaccttaagagggctgatcctgataccagctttgcaacaagggtggttaggtttcttttcttttcttttttttttttagatggagtctcagtcgcccaggctggagtgcagtgctacaatctcagctcactgtaacctccgcctcctgggttccggtgattctcctgccttaccctccagagtagctgggactgcaggtgcccgccaccacgcctggctaattttttgtatttttagtagagacagggtttcgccatgttggccaggctggtcttgaactcctgacctcaggtgatccatccggcccagtttatttttgtcctggctgtaagtcattgatgaggaaggagaggggtttcacctctcccttgtctgagttcaggaggatttttaaaaaatttttttagaataggccaataaggaagggacagcaaatttttagaaaaggccaataaggaagggacagcaaaacaaatcgttggcatagggcagagaaaagctaaggccctggcaagctctgctgctggagtctgcatagggcagagtggagggagttccacaagacatgatggctgcaccaaaaacactcatgtgggtctggctattttgatttgccaggaaagcgtagataaagagggaggatccctttctcagtgacatagacattcttgggaagaaaagaggggtcctccacagggctctgcttcatttatgatgcagttcatgaaatagaaaaaaatgggccgggtgcagtggctcactcctgtaaccccagcagtttgggaggccaaggcaggcagatcacttgaggtcaggagttcaagaccagcctggccaacatggtgaaaccccgtttctactaaaatcacaaaaattagccaggtgtggtggggcgtgcctgtaatcctagctacttgggaggtggaggcacaagaattgcttgaacctgggaggtggaggttgcagtgtgccaagatcgtgccactgcactccagcctgggcaacagagcgagagtccatctcaaaaacaaaaacaaaaaaacaaaaaaacaaaaaaagaaaaaagaaaaaaatgttcagtacagggagtggaggatctcaggacactattggttggattatgggttgtagggaagggcttctttgagagaaacagaattatgggaaaaaaggacttggacactagagggaaggaaggcaagaaagagaagtcaggaagagggctggttgagcaatgaaaggaaaagaaaggtgatcatcactggtcccatgtaagggccagctaaggaaaaagtcaaaccttgaaatctctaggacaatgttttccaaagtaaactttgaagaactcttaaagctctttacaatttcatgctggaatcactaaggttggggcaagagagaaggaatatatggggtaaaagtagggtgggggagaaactggcatttagagagaaatacaagcatatttatccataaggaaatagggaacttagagattatatacaggttaaaatgcagaatgtgagagaaaaagagaggaattaagagccaaaggaggaagatatttactcagatatcttttggagccggtgttagggagcggaaaatcttgcctttgatagccactgccctgagagggcccaggaagcagaggttagctgggatccaggccttacacatctaaacattaattagaaaatctagactaaagtaaggatactgaatggggggagggattcactgtcctaaatagagtggccttgaaagaaggaaaaagtgggaatccaccagtgtttccagtctgcaggtgggaaggatcctaggtatcaggagatgagtgatggaaattccagggtgaaactggataaaaaactgagtgacatgagagcctgtgggccagaattggagggtggggttaggggcatggaagagaggctctaatcagggcttggactggaggccacatggagtaattcattgattctgggctgagctaagcttgggatgaaatagaacagccaaagagagtagagagctgttcttcagggccaatcagcatcagaatcagagtgaagaaattcgaggtcaagtttgggtgggaaagtgaacaccggagtggaacagagagggtgctggagaaagtgacacaattgttggggtagaataggaaaaggtagaagccactgatgattacataacccagagggaagaccctaggcctttgagttttcaaagagaagggaagtttcttaatgctggagtttgaattaggtgtgagtccatggttgccagagtgtttagtgtcaggatggccaaagagggaggtaatatctacttttcggccactaggatgctagtacagtatttgatataattttacatatgaactaggctttattaatgcccatttttgaatggttatccttaaaataatgtagaaatggttctttttctaaattaaatcattccctttcccactgttcataacttaaaagcaatcttttatgatgagaactttctttggcgaactgaagtttcattctggtcaagagtaaaatttaactctgtgtttctatccccgtaattcaaatatgctgttctagttttcttttttattctaagcagaagtgaccttttccccataaaacataaaaaaggatcttttttttaaaaaaaaaaagtaactgagtaactgcaggctgcatgtcaaggtcatattttccctggtcaatgaattatgatgaatttgaatacagctgatatattatttgtaaaatgtggtaattttcagatttactcatcacagtatgtgaggcaggatacctcttcatttgtattttaagaaaaccttaagctgaaggtccgtgaggaatccagagtaccaaggagcagggaaagctttgtgttttgggcttctttaccgtgggtctgctgagaaacaaaatttggttacctcattactaaggtatgcctagaaatcatagtgttagtgccatttaagggtactgttgagttttgttataatgctgatgtccagggacaaggagaacaagcagatttttgcttttccaagttttgtggagaagtgcaccgtatatgactatgatcgcagaggtgagttgatgcactgtatacctgaatccatgagatgattatcttctgataatgaggctttactcagtttaacttggttgtaccacaccccagttagtatagtacagtggttctcaaacttgagctcctcagaattgcctgggggggctttggagaccgacaacctcaggttagagtgcttgctgttctacttcttagctatgtggcaggaggcaagtcacttaacttactttcgttcttttttttgacagagtctcactctgtcacccaggctggagtgtagtggcatgatctcggctcactgcaagctccgctgcccgggttcaagccattctcctgcctcagcctcgcaagtagctgggactacaggcgcccgccaccatgcccggctaatttttttttttttttttttttttttagtagagacggggtttcaccgtgttagccaggatggtctcaatctcctgagcttgtgatctgcccatcttggcctcccaaagtgctgggattacaggcgtgagccaccgcacccgtctttttttttttttttttttttttttttttttttttttaaccggagacagtctagctctgttgcccaggctggagtacagtggtgtgatctcggctcactgcaacctccgtctcctgggttcaagctattctcccacctcagcctcctgagtagctgggattaaacgtgcccaccaccatgcctggctaacttctgtatttttagtagagacggggtttcaccatgttgaccaggctggtcttgaactcctgacctgaagtgatctgcccacctcaacctcccaacatgttgggattacaggcatgagccaccgtgccaggtcttcacttaactctctttgtttcttttttttttgtttttagacagagtcttgctctgtcacccaggctgaagtgcagtggtgctatcttggctcactgcaacctccacctcccggcttcaagcgattctcgtgcctcagcctctcgagtagctgggattacaagcgcccagcaccacgtccagctaatttttgtatttttagtagagatggggttttgccatgttggccaggctggtctcgaactcctgacctcaggtgatccttccacctcagcctcccaaagtgctgggattacaggcatgggccaccatgcccggcccacttaactttgttgagcctcagttttctcatctatacaatggagatgataataccaatttcacagggctgtgaggattacacaaaatcatcccaggcccatagtaggtgctcaataaatgggacctattattttatatatatatttttttctttttcttttttgagatggagtctcgctcttttgcccaggctggagtgcagtggcgctatctcggctcactgcaagctctgcctcctggattcacgccatcctcctgcctcagcctcctgagtagctgggactacaggcgcccaccaccgtgcccggctaattttttgtatttttagtagagacggggtttcactgtgttagccaggatggtctcaatctcctcacctcgtgatccgcccgccttggcctcccaaagtgctgggattacaggcatgagccactgtgcccggccctattattatattattatctaatttttcttgttcaattgtatcctattatgttatagtaaacatggtggcagcatgaaaactatcaacagcttctcagtggtccccttatatcttgattctctgtcctctttcttcatattcctgttgtattagtacacatttggcatttacaacatgctaggaagaaagcttgactcatcactgcatctacctttgaggtggaagtggcggcttctttaacagctatgctgtaacactgctcaatagttcaggacaggaactgaggagtgtatatccagttgaaactctagggaacatttcgggccatgggtgacatttttaaaaaccattgctttctgaaaagggctgttgtgtttatttaattaattaatttatttgtttatttattgattgatttatttgaaaccgagcctcactctgttgcccaggttagagtgcagtggcgtgatctcggcttactgcaacctccgcctcctgggttcaagcgattcttctgcctcagcctcccgtgtagctgggactataggtgtgagccaccatgcctggctaatttttgtatttatattatttatttattttttgagatagagtttcgttcttgttgcccaggctggagtgcagtgatgcaatcttggctcactgcaacctccttctccttgtttcaagtgattctcctgcctcagccttctgagtagctgggattataggcacccaccaccacgcctggctgatttttgtattttttctagtagagatggggttttgccatgttggcctggctggtctcgaactcctgacctcaagtgatccggctgccttggcctcccaaagtgttgggattacaggtgtgagccactgcgcctagtctatttatttatttttgagacagggtctggctctgttgcctcagcctcctgagtagctgggacaggccaccatgcccggacaattgtttttatttttatttttagtagaggcagggtctccctgtgttgcccaggctgttcttaaactcctgagctccagcattcctcctgtcttaacttcccaaagtgctgggattacaggtgtgagccactgtgcccggcagaaaatattcttttttttttttttttttttttttgagacagagtcttgctctgctgcccaggctggagtgcagtggtgcgatctcggctcactgcaacctccatctcccgggttcaagcaattctcctgcctcagcctcctgagtagctgggattgcaggcgcccgccaccatgcccagctaatttttttttttttgtatttttagtagagacggggtttcaccatgttggtcaggttggtctcgaacccctgacctcgtgatccatccacctcggcctcccaaagtgctgggattacaggcgtgagccaccgtgcctggcgctttttatttttatttttgtttctgagatggagtcttgctctattgcccacgctgaagtagagtggtgcaaactcagctcactgcagcttcgacctcccgagctcaagtgatcttcccacttcatcctcccaagtagctaggaccacaggcccataccaccaggcacagctgatttttaaaataatttttgggccaggcacagtcgtcacgcctataatcccaccactttgggaggccgaggctagcagatcacttgagcctaggagttcaagaccagcctgggcaatgtagcgagaccctgtctctacaaaataatacaaaaattacctgggcttggtggcgccaggtgtggtggcatgtgtctatagtcccagctacttgggaagctgaggtgggagggccacttgagcccgggagtgccgctacagtgagctgtgattgtgccagtgcacttcagcccaggtgacagagttgagacccagtcttaaaataacaacaacaaactctttgagctaatactgtttaatgaaagctgtatagatacacctttgaatgaataatatatataaaattagttgaacccatagctgagtctgttctgttgtgagaaaatagaaagaataacctgataatggtctctccaaatatttgtgttatgtagtccaggagacttttataaaagcaaaagttgggtgaggaagaattgtcttttttaaaaccatatatatatatttagagaccgggttatgagactggctaatttttgtattttttgtagagacggggtttcaccatgttgccaaggctggtctggaactcctgggcttaagtgatctgtctgcctcggcctctcagtgttgggattacaggtgtgagccagtgcgcccagctaggaattgtctttaggtgaaaaattgcgtatcatgaatatagtatactgaaatggagacaccagagggccactgtcacagtctatggcaggcaggacccagaagcatctcaaaagggattcagaatgtctcatattacaatgattcaagtttagagtgtgaaaaacacactaaatatttatatggtcctgctgaagaccaagattgagggaagccaatttgtgtttttgttctagcggaaattagaagtactcaaaaaatgaccctagatatttagggtgacattttgaggttgctttgccttttgaaaggactgattaatttcacaatgatcacttaagttttgcgtgacatctagaagttgtataaaatcttgtagctagagccgaggtttattataaagctatgatgaggtgtttttgttaaatggagtaaagtaattttcttacagcaggaaatggaagtgagtactgtttgaataataagaaaaaagtatcatagcaatgggtagaaagcaaaaagaatctggcggtatgaaaatgtaagtgaggccaggcacgctggctcacgcctataatctcagcactttgggaggcaaaggcaggaggactgcttgaggccaggagtttgagaccagcctaggcaacatagggagaccctgactgtactgaaaaaaattttaaattagccaggtatggtggtgcacacctgtggtcccagctgcttgagaggctgaggtaggaggattgcttgagcctgggaggtcaaggttgcagtgagctatgatcatgcgattgtactccagcctgggttacagagcaagacccgtctcaaagaaagaaataaaatgtaagcaaaagattaaagcttttgcatttgactacttcattcttggaatagattacgtatggtccttttttttattttttaatttttattttatttatttatttttttgagatagagtcttgcttttgtagctcaggttggtgtgcaatggcacaatctcagctctgaccccccaggtccaagcgattctgctgcctcagcctcccgagtagctgggattacagatgcccccccaccatgcccagctaattttttgtgtttttagtggagacagggtttcaccatgttggccaggctggtcttgaactcctgacctcaggtgatcgcctgccttggcttcccaaagtgctgggattacaggcgtgagccaccatgtccggccagtctatggtccttttctaagtgctttcatgttattccaaatttttagtagggactagtagtttattcccattttgcaggtgacatggtaaatggacatagagagatagtctgagatggctgagaagtggggactgggagtgttctccaagttttcccaccgcagtgtaggctatgggtgctagagtatatcacttttcaaggcattacttgattagatggttctgtttaatattgctgctgtttgagtagattgttctgaatggattttggatgttcctaaacatcagatcgaccctgaaaggatgggttccagcactaatgaggagagtgaaaaggacgtagtattggtctggatgctaacgctcacagaggaactccagggagattgcaagccctggccgctcggctgagatgactgtccagcctcctgaggcgactactttggggtaactacattcatttgaatgataaacgctcatgtgtttaacagcagttaacattcctttgtatccagtctcataaatgtttataggtaaggttttagacatggaagtacccaaagagtctatgaaggggtccatgctagacctatatgccggcaactacctagccttcccactaaataccagaattaatgtatctgggcaaaagatacaatatgccttataagactgatcccttggggtagatatcagtggaaatatttggataggaaaaaaaaaatccaggggaagtagaaagtgttagaatagatttttagtcaggcagaagtttgggatgaacagcagaaagggctgttctttctcctttaaattgcctggcagattatttctagttgattttgtgtgtgcagtagtagaggaaccaacttggcatgaagagaagcaaagtaaagtgtttgggggcatgtctatgggacttcttttttttttttccaagacagagtctcgctctgttgctcaggctagactgcagtggcatgatcttggctcactgcaacttctgcctcccaggttcaagcgattctcctgcctcggcctcctgagtagctgggattacaggtgcccaccactaggcctgactaatttttgtatttttagtagagatggggtttcaccatgtggaccaggatggtctcgaactcctgacctcaagttatccacctaccttggcctcccaaagtgctgggattacaggcatgagccaccacgtctggcctctctatgggactcttgagtttcagggaatatttggttaatggtagggaaagatgagggaatatagatattgggggtaaagattgaggagaattttcgaatacccttatatgtattagatcattaaataagtttatttttatttttattttttgacacggagtctagctctgtcacccaggctggagtgtagtggcctcatcttggctcactgcaacctttgcctcccaggttcaagtgattcccctgcctcagcctcccgagtagctgggattacaggcgcacaccaccatgcccagctaattttgtatttttagtagagatggggtttcggcatgttggccaggctggtcttgaactccagacctctagtgatccacctgcctctgcctctcaaaatgctgggattacaggcctgagccactacacccggccagaacggtttaaattggggtaacttcctcattgggggcaggggttgtggtatgtaatgaagtagggaaaacaggaatgttagtctcctaacacattctgttgaatacacatggaagaaggcagagtaatcaggagggcaagctctgtagtaggagttccacatctaaagccgggtaaagttgtccttgctgggtgtgtgtacattttcctatggaaaacaatgagcagatttgccttcactctaaaagacttctgggcagaagtcatggccttttccctttagccctgagatctcagtgtcagtggtctcttagatctcctcaggggtgtcttagatgctgttttttcccaagtggaatgatgaggtggcctctccttttgctgctgtaaagtttgcctctgtcttatgggagctttaccaagagctctgggtctctattggaggagtaggtcccaaagttggttttccttacttattagtcatcactgacccagccctcctccttaaactgtctgctggccacgcctatcctctagaggacagattcagggccaggcttcaagatgaatattttccggctctttcattttttaaagtcataattgcttccaggtcaccaggcagtatgaaccaaaaggagcctgggggagcaggactacatttcgtttaactgagagcttcttaagcttgggtttctagtttactgtcttgatggtagagtccaagcatgaataaatgggtaggtttcatgctatgtgtagaagaccgagttgtgttccataagttgagtgttctgcacttaaggggtcttcagccacaaagggaactacatgatcctgaagtacttgtcagctgcatgaacatcctgatcattttcttttatttatttattttttgagacaggatctctctttgtcacccaggctagagtacggtggcgtgatcttagctcactgtgggcttgacatcctgggctcgaaggatcccttctgccacagcctcctgagtagctgggaccacaggtgtgcaccatcacacccagctatttttttattttttatagagacgaggtctcactatgttgcccaggctggtctcaaactcctgggctcaagcagtcctcctgcctcagcctcctaaagtgctggggttatggacatgagcccatgcctggcctggtcctttttaaggttaaaaacctcgtaaacagtgcctacctcagtcaaaaacatttgtcagatagatgctttctctgttacctcctttaatgtccttctcttcctcatatgcatgatgacaaccatgcttttgcttgtaattgttgtgaaatctgcatgttttggcatcttcatttcaaaacgaaacaaaaaaatcctatcccacctgtaaaatctcctttgagattttggtgctgcctatcctctattactaactcccccagccccgacataggctataatttgatgttattcttccccttttgagaacacattctctctaaacttttctaaaatgtctgtcttcagtgcttccccacagtgtttcagtttggcccatgatggtgaaatatttcaggttcccctatttcattttttttccttttggttattgcatgcgatgggcttttcttttatgcctatcacacctgcccttgtcttctagtgtgttctatttggattgttttaaagatctctgcttcattatggtttctcttccactacccgctcgccctcagcttagctgctatttttcaccattttaaagttattgcggccaggcacggtggctcactcctgtaatcccagtacttttggaagccaaggtgggcggatcggaaggtcaggagttcgagacgagcctggccaacatggtgaaaccccgtctctactaaaaatacaaaaattagccgggcatggtggcccatgcctgtaatcccagctactcaggaggctgagacaggagaatcgcttgaacccaggaggcggaggttgcagtgagccaacatcgcgccattgcactccagccttggtgacagagcgagactccgactcaccaaaaaaaaaaaaaaaaaaaaaaagttattgctctctcattagttccttttctttttggtttcccctgttctgtagtgtggtgattgtctctggctacctactcttggctgcccacctgttggattcatttcctgggatcttgggtaggccttttacttctctgtgcatgtgcctcctaaattgaagttttacatatatatatatatatatatgtatttttttttcccagccacacttatggctttggattggcagagcacgtgctctcctttgtcctcaccatgagttggatatatcttttgagttttttcccccaaagtagggatagctcacagtggttcctctgccttccaggcagtgaccagggttgattcttgggccatgcagctgttcatttctttaacaattacatggttgtgacatctgggaaaatcctttgaggtatttcatatccttgtgcctgtgcttcctgggtcatttgggattaccaggtttcttccaagttcctttttggaactttgcttttgatgtgatgatttccatcagagagagggagagtaggcggggtggtggggggaggtgggaagggagaacacatgagtaccggtgcttcaagcaaaagcaagccagcatacaagtgtgtaaaccagcagcgcttacgaagtgtggcatgcctgcaaggcttttcctttttgctcacctctcctgggatactaatttgattggctataatataataaaacaaacccctaggcctactgaatcagaatctccaggactgagacctaggaatctgtattttgaacaagctcctcggtgattctggctggggaaacattggttgacattgaccgtcctgactcctcccttctgtgagcattcacgcagtcaggagtctgttctctagggccgctttagaggttccctttgctttccctctggctggggaagaccaatcttgccttcttgtatagaccatgtagctcagtgtcagtgttctcctgcctgtgttttatccctcccctcctctcctctcatctgcagaggctactgttaattagcaacagtgggcttcagataggaagtggcgctcctgggacaaaatcatgatagaaaattgagaggcaaagatttaagtggatgctccatcttgaggatcttgtgaaaatggagttatccagaatcagcgttgctctctacgtggtcataacatgtgtattatatagtaattattttgatattttaactcggttttattttttgtggttttttttttttttttgcctgaaagctctttatctaggtgatgttgtatgatgttctgtttccaaatgccagtgttccccctctgatttctgtcccagaccctacatactactaatcctaatcctctctaaatagagcaatacgaaacctgagagtgaaaaatctagtgtcactaatacctgctgcctatagatatttagtagcaactaaaacttgtactttgtgttgaaacacatctttttttttttttttttttttttttttttgagatagggtctccctctgttgcccaggctggagtgcagtggcgccatctcggctcactgcaacctctgcctcccgggctcaagcagttctcccacctcagcttcccaagtagcagggaccacaggtttgcacagccacacacggctatttttttgtattttgtagacatggggctttgccatgttgcccaggctgatcttgaactcctgagctcaagtgatccacctgccttggcctcccaaggtgctgggattacaggcgtgattacagtgggattacaggccactgctctgggcctgaaatgcattttatggcaagaacagccccttccattgcttgagtcctctaattctttttccccccccccagacagagtcttaactgtcgcctaggctggagtgcagtggtgcgatcttggctcactgcaacctctgcctcccgggttcaagcaattttcctgcatcagcctccgagtagctgagattacaggtgcctgccaccacgctcggctattttttgtatttttagtagagatggggtttcaccatgttggccaggctggtctcgaactcctgacctcaggtgatccacccgtctcggcctcccaaagtgctgggattacaggtgtgagccaccatgcctggccgagtcctctaatgcttagtagagagaaaagatgaaatgagtacctggggtatcagccaataggctgagctggttttgtttttgtttttgttttagacaggattttgctgtcgcccaggctggaatgcagtggcacaatctcagctcactgcagccttgacctcctaggctcaggtgatcctcccacctcagcctcccaagtagctgggaatacaggcacccgccaccatgcccggctaattttttgtagagatggggtttcgccatgttgcccaggctggtcttgaactcctggactcaagcaatcctcccagctcaacctcccaaagttctgggattacaggtgtgagccactgtgcccaaccagtgttgttggttaaaatggggatattccaagatattctgagaaacagtcaaaacttgattaaccaggatgttcagggaacggggtccttgttaaaaatatttctaaaattatgctaacccacataactgtcttcataatgttaaaagataattgtcagaaaaaaggtaaaaaatcatgactctcgtacagatacaaaaatgaacacgtgttaaagattttattttactcattaatcaacaagagaaccagacagatgttatagctggttcaaacaaaaagtcaaaaagcacaaatttatatggagtaaaggaaataaattgcaaatggaggcaaaagtagtttttctacagtggggaggaaagacaatccaaactcaatgggacaagacagacttcgcatatacatcagttacctgcaattacagagatgcaaaatagcttgaagacaataacctgagctaaaatcagatagcccagaaggttatgctatagacagtgcatagttttttcattggagtacaaaggtttttctgtagtaagcaaacatggtggatgctttgtgtgtgtgtgtgtgtgtgtgtgtgtgtgtgtcggggggtggctgttgattttgcttcttgtgatttctcagggccgtcacttcagttcttatccagaattcagttccatataacatgcatttactgagtagttactatacgtaaggtgtcgtggaggaaacaaagacaaaaaaggatgctttttttttctttttcttttttttgtttttgagatggagttccacccttgttgcccaggctggagtgcaatggtgcgatcttggctcacctcaacctccgcctcccaggttcaagcaattctcctgcctcagcctcccaagtagctgggattataggcatgtgccaccatgcccggctaatttggtattttaatagagatggggtttccccatgttggctatgctgatctcaaactcctgacctcaggtgatctgcccaccttggcctcccgaagtgctgggattacaggtgtgagccaccgtggctggccaaggacgctatttcttaccttaggtagctgattggtgggggagacaaacatgccttgtccccaactaaccaagctagagaggagaataagaaccagtgctgtggaagaggtagggagtaaatacttgaggacaaccagagagggaggggttaactgaactcgggctggggctagggggatgacatgatgacatttaagctgagtcttgagagaagacagggagaggaagagggggaagcaggagaggccatttcagggtgaggaggcagaagagtcctgaaactggatggtgtgtttaggaagggttgggagctgggggtggtgagagtggtggggaaatggcaggatgtggtggaagaggaggctggagaggaggtttgaggccaggtcatgagggccctgaaggcagtgctgagaatggctggctgggtgctagaggccggggaaagctattgaaagcttttgaggagggaaggagtgacatgatcgaactggcgctttagaagatgaattgattgtagaatcaagaaattgaaggcagagggagcagttaagaggtgattataatattctgggtgagagctgatgagggcctgcaccagggtagtggcaagaagggtagaaggcaaggctggagatggcattattaaggcctgacttctgatcgaatatgggcggcaggggagagaaggagttgaagatgacaaggcggaaatttccaggctaggggacggtagtgccgttaagtaagctaggaaacacgctgcttactgggcatagggggtggggagcaggtttatgagaacagataatgagtatggtttgagacacattgagtttgaggggcttggtggtcatccaattaacagcaagttgctggcagctggaaattctggtctgggcctaaggagagaggtcaaggctagagatacagatttgggagtcatcagtgcatcaaggggcgagctgaaactgtggaagctcatgagctgagagagaaggtggggcagggctgacaactggcacagagggagagagatgggtgggggaagccagagagagccagcaaaaggcagactaggaggaaaagagacagagggagaccggggagggaccggaagagggagactgaaggccaaagagtagaggggagggggaggcacaggggagggagaaggggaaggagggggagagggaggagagaatgaatgggagactgagggaaatggggaaggtgagataagcaagaaaaagacagggaaggagagaggtgggaacggggagaaagttggaggagaggggattgtgtgtgtgtgtgagagagaggagaaaggcaagaggtgaacagctgggaaaataataggggagagaaaggtgaggaggaggaagagtaaagagagagagatgggtagggggatgagaaagagggaagaagccttgaaagataggaaggggaggaaatgggagagggtggcagaggtgaagagagacagagatcaagggaaaggccaggccccagtgaatgcccaagtctttggggtgggcagtggaagagaagggccccggagaagccatcaggcagtggatcaggaaagacaagagaagggagagaataaagagggcaacgtatcccactctgcagagatgaggaggaggatgaagcccaggcagggtggatgcctctctcctctcttctcctaccacctccacactggtctcctggctctcccttgatctttgtgggcaacctcctgccttaggactttctcatgcactgttccctcagcctggaatgcttttctcccaaatatccacgtggctactcctttacctcattccgatggtttaaatgtctcctttacagcaaggcctatcctgttcaccgtatttcagatagtagccctccccacctagactgtgcccttgccccttagtctgtgttgtattatctcctcctcctcctccttcttcttcttcttcttcttctttttttttttttttgagacagagtttcactcttgttgcccaggttggagtgcaatggcatggtatcagctcgccgcaacctctgcctcctgggttcaagcaattctcctgccttagcctcctgagtatctgggattacaggcatgtgctaccacggtggctaattttgtgtttttagtagagacagggtttctccatgttggtcaggctggtcttggactcccgaactcaggtgatccacctgcctcggcctcccaaagtgctgggattacaggcatgagccactgcacctggcctgttgtactatcttctaacatgccgtgacatagaactatttaacatgctatgacatagaagtattcaacatgtttattgtccatgtcatccccctgggatgtaagctccacacgggcaggcattttgttctgtttcgttaattgctgaatcctcagtacctaggatggtgctggctcatagtaggaatgcaataaattgtgatactgtgttgaaagtggacaatctctgaaaattgaaaaatggatacatgaaacaaatccctcgtacaactatatcttattgtgatttactttggaaagtggagaacagcattcaattctgatcactgtagggttctgttcagttgaacttcaatgaataaggattttagctaataagctaactcaagagcttaagggtctcaaggcaagctcattggataaaggtttttcttggtgcctcattttttctagaaggtaaattaactgtgccctgcttgtcaaagcgagagagggacattggctggtgaagagagtggtggaacatggagacaacagactgacaggaagggacaaggacagaaatgtgtggtttttttttttttttttttttgagacagagtcttgctctgtggcccaggctggagtgcgctggcatgatctcagctcactgcaacctctgcctcttgggttcaagcgattcttgtgcctcaacctcccgagtagctgggattacaggtgcacaccaccaccccaggctaatttttttatttttagtagaaacggggtttcaccatgttgtccaggctggtctcgagctcctgacctcaggtgatccacccgcctcggcctcccaaaatgttgggattacaggcgtgagccaccgcgccctgccgaaacacgtagttctggatggaacgttgttttctgtttgtttgcttgttggtggtcagcgtgcaaggagtactgcacctgatttggagggagcttgaaaccaggttagatacgtgtgttatttccaactcaaagtcaatggagtatttttgaaggacttacgaaaaaaagcatgtgcttcctctgaagagtgtaaattggctacgtcactcaaatacttcagtacccatggattagagagtagacgagaaaaaggtcaccagtagtgttttagtgcaccattcatatatgggtatgactctctaattgtagttggttaggctaaatgtgtgtagaaatatatactgtcatctcatttgtctgaaatagattgaatttcctctactcaagcatatctgtcttttaagataatttaaaactcactctaggtgattaacaatgtcctcatctccatcctgaaacctatggattcctagaaagctggtgctccctcttcccggtttagaccttaattttccatagcaggctggctgctttaacattctgatgctgtaattacctttattgaaacattgctgtgtaaaaggtgattgaagcagctgtccctgttacgagttttgattttctggaattcttttccccagggggagtggccacagcaggtcctatctggtggtgagtggctgtcatgatctctacagcaccgctctacagcggcgtgcacaactggaccagttctgaccggattcgcatgtgtggcatcaacgaggagaggtgaggaggccaggaaggtggccgctgctggcctccagtgagcagtacctcgtcaccagagggatagctgcatacaatagggcctggggagggaccctggggaggagaagactcttagttgtttctaattttcctgtggtgggatggggatggggctgtgtgagtggcctgatctgccatgctatctcttttcagatgaaggtgaggaggccaaaaaaatgaccttttgccagctagcacttgtctactcattaacaactgtcagactgtggagtaaggggaagctcaggcaatggcaattttttttttgttttttgagacagagcctcgctttgtcatgcaggctggagggcagtggcacaatcttggcccactgcaacctccgcctcctgggctcaagtgattctcccacctcagccccaccagtagctgggaccacatgcaagcaacaccacgcccggctaatttttttttttttttgtagttttttagagacgggggtttcgccatgtggcccgggctggtcttgaacccctgagctcaagtgatctgcctgcctcagcctccccaaatgctgggattacaggtgtgagccactgcccatgcctggccagcgattgcagtttttatttgctgcatcaaagtttggtgctcaaggatatgtgtaaggtattttcagtctttgatctaggtctggaagaaagatggttttattgttcagatttctactgggaactggcagtgggcattctggtggtcagcgctttctcacctcatgaggctaattctgatttgaagtgagatccttatgaagtatcaaaggaagttgagaccgcctagcatagtcttgagagttggtgacacctgcctcacgtgtgtattttcagttatctgttccccagaatatttggttgaccaagatgtgccattgcctgatcatgccccatacccaaagcactcaaaatggccttcagaatttatatttggctttcataacccttggtcaaagagctgtgtgtgatggctgcagtgcctctctcattttctttttttttttttttgaggtggagtctcactctgtcgcccaggctggagtgcagtggcgcgatctcggctcactgcaagctctgcctcccgggttcacgccattctcctgcctcagcctcccgagtagctgggactacaggtgccgccaccaagcccggctaattttttgtatttttagtagagacggggtttcaccatgttagccaggatggtctcaatctcctgacctcgtgatccgcccgcctcggcctcccaaagtgctgggattacaggtgtgagccaccttgcccggccgtttttattttttatttattgatttatttattttgagacagagtctggggctacaggcgtatgccaccacacctggccaatttttgtatttttagtagagacggagttttactatgttggccaggctggtctcgaactcctgacctcatgatccactcacctcggcctcccaaagtgctgggattacaggtgtgagccactgcactcggccgcctctctcatttttagagaaggcactgctccttcatgcttgctggtgtttttttgttgtttcaatccattgactgtttaaattcaaatatacatcagataaatcaccaagacacagaacaatatggctttccctgggattcaagatctgacgtttcttgggtaaatcttagaaatgtgtgtgcgcatataggggagtattggtaatttgaagggaaaaggaatggaagtctttgtgtttatctactttgttcttctgttcctaactggagaagtatatacttgtctgaggtcaaggttagcagaatagacctttttattttcttaagccattagtgcctgatagcttaatgttctctgtactgaggaacaagttagagatgggcttaaaaggaatttaattttaggataaaaagagtcaagaccatggaaaatgagatgaaattcttaggtgctcaggaagaaaagtgttttcctttacatatgaagcatgtcctcagatgatcactaagagatgatctagggaaaggcagggtgatgataatgatttgcgtaagtattcattggcaggtcatgttgacctagttataagtagttgagactttgatgcagaaatctggactagagccttcaaaagaccagcggggccgggtgctgtggcttatgcctgtaatcccagcactttgggaggccgaggcgggtggatcacctgaggtcaggagttcaagaccagcctggccaacatggcgaaaccccgtctctactaaaaatacaaaaaaattagccaggcatggtggtgtatgcctgtaatcccagctactggggagactgaggcaagacaatcagttgaacccgagaggtggaggttgcagtgagccgagattgcaccactgcactccaaccggggtgacagagcaggactccgtctcaaaaacaataaaattaaataataataataaaagaggccaatagacaagttaccttagttcaccatctactgtaaatccctgccaagaaaggagcaggaagtaggctcaaaatctgattttccctccatcttgttttttgtttttgagatggagtcttgctctgttgctcaggctggagtgtagtggcacgatctcggctcactgcaacctccgctgcctgggttcaagtgattctcgtgcatcagcctcctgagtaactaggattacaggtgtgcaccaccatgcctggctaatttttgtatttttagtagagacagggtttcaccatgtcacccaggctggtctcaaactcctgatctcagtctgtctgccttggcctccaaaagtgctgggattacaggtgtgagccactgcacccagccagattttccttccttctaaacctgtgcctagtgcttaagaggacattttttttttttttttgagacagagtttagctcttgttgcccaggctggagtgcaatggtgagatctgagctcaccgcaacctccgcctcccgggttcaaacgattctcctgcctcagcctcccgagtagctgggattacaggcatgcgccaccacacccggctaattttgtatttttagtagagacgggttttctccatgttggtcatgctggtctcgaactcccgacctctggtgatccacctgcctcagcctcccaaagtgttgagattacagatgtgagccaccacgcccggcctaagatgaccttttaagtgttgtcacttttgatctcatccaccctttattgtcaccttcttgctacagtctaggccgctacagcctagaccatgctatcactggtttccaaaatgtaatctcaccttatttaaaaatcattttccttggccctttacaacttgtagaatttaggaatttggggtacaaagctgtgcctggggttcaactcttaaagtgatgttttagaggcctgccagctttggcagctgcaattgaggactgtagaacaggaggcatgggcttgcggctggccccaggtggccgtctctaggcaaacctacagctaaatgtgtctgcttgcctgcttgcatcccttctaggattaattcatgccttcattcaacaaacatttattcaacataatgagagcaaaccagtagttctagtacattggtggtgagtgccctagaattgcatgtccgggtccagtgggagtccaaatgcaagattgacaaacctcctggtgggagaataaggaaaggcttcccagaggcagtggcatttgagcccaggcttgaggaatgagtaggagtttgaggtgagagctggtatttccctgagacaataagagcacagtgtggctgggcacggtgactcacgcctataatcccagcactttgggaggccgaggcaggtggatcacctgaggtcgggagttcgagaccagcctgaccaacacggagaaaccccgtctctactaaaaacacaaaacttagctgggcgtggtggcgcatgcctgtaatcccagctactcgggaggctcaggcgtgagcccgggaggcagaggttgcagtgagctgagatcgcaccattgcactcctccagcctgggcaacaagagagaaactctgtctaaaagaaagaaaaaaaaaaaaaaaaagcacagtgtgtttggggaaggtccaagttggaatgaaggcaatcttggggtactgtgggactcgaaccagggaaagtctcccaggactggaaggtaaggagcctggtgtgtgctgggtggtatatttctcttacgggtagtctgggcccagcaggaactgaagagggtccggtttgacagtggtgctagcccttaataattagggaaatggcccagaggggtcatggccatttctggtttaagttccacaaagccttgaacataacagctctgcctcctctgtggtgggaagaaacagcaggattgattttcagtcctgactgaagcctgctatgacctctgttccctcctgccgcccgcctccgccagctgcaccctcataaccttgcctggttgacccagctcttcccgggccccctcccctgcaagttactcctgtcccaggctcttctctcaatggagcaagttaatgtttgcttagctctgcccacccctcttctcagaggatttgaaacacggctgcatgacattttgcagcgccttcggggctggactcaggtgtgggtatggctggagtggccaggactgctgttgcttggcctggttctgtggttctctggcagctgccttcgacggcagggattctgctttcgaggtgtcatttcaggcagggtgggagcttgcaaggggagaatgaggatgcagcccactcccttttgtatggccaggaggggaaagaatgtaaataaatagcaccttcccatgtggggttgcttgggggaagtgctgcttgtttccccttgagtactccccctaaaaccgtccctggcaagtctagtgggaacacgcttccccctggcccaaggctgggcataggtctcgcttttgtggtctcttaggagttgatgtgaaagtatgttttccctttccttcaggccctccctccctccccttccccgagaccaccctgactgcatctaaagcccttgcctctccttacagtcatttctgtttgtcaccaacagtcacttccagcagtggagccctcccacttctgccagtccaactgccttttaaagggaacaagcctttccccctcggttagccccttctggatccctgaaaagatggggagaggcccgtggtgatcccccttgccttttttgcttctcttgccccaggtacaattttggagtccctgtttcagtgggagggaggaagttagcagggccctcccccttcttgttggggttggctccagcaacctgactgccctttggctagggtgactggggaggcgagagctggcttcttcagggctgtcttcaggagcttggggtgagcctctaaagaagggaggcaaaaattagccaggcgtggtggagcatgcctataattctggctatgctggaggctgaggcaggagaattgcctgattccaggaggcggaggttgcagtgagccgagatcgagatcgtgccactgcactccagcctgggtgacagagcgagattcaatctaaaaaaaaaaaaaaaaaaaaaaaaaaaaaaaaagagggaaaaaaggaaagaaagaagggaggtcacctcaggcacagtgtatttccccaggggcacacagagcagtcctgtgccttgcccacccaggaaacgcactgcagcgtctatgttggggttttattctttaatctaaacctcctccttggccactcccacccacagctcccaagggcagggggcaatagttttttttggttgttgttgttgttgttttgagacagggtctcactctgtcgcccaggttgaagtgcagtggtgggatctcggctcactgcaacctccgcctcccagactcaagcgattctcctgcctcagcctcccaagtagctgggattacaggtgcctgccatcacgcctggctaatttttgtattttttagtagatatggagttttaccatgatggccaggctgatattgaactcctgacctcagtgatgcacccacctcagctggcctcccaaagtgctgggattacaggtgtgagccaccatgcctggcctaatagttcttgctgtacttaaaataccaggggagggaggcagtctgatgccaccctctccctttttttttttgtcaggatgtacaattttctatgatgcttacctgaaatttggagaagactttaaacagggggagatgcatttgagttttcctcctttgggacccagctctctggccttgagcccttttctctgggacatatgaacctgaatttggggtctgaggcttttcggacaggagagaacaaagtggtgctgggagactgatgggggggcagggaggggtgctggcaggagataggatgtaggcaaggatagaaggagggtagaagggagggtgttgcctagaactctagaaaaaagggggcagtgtctcctggagggaaaaaagtagtattcttaaaatgcctctcagcacccagtgacctggtggcctccaagtggtatcatcaccagtgctaataaacatgtctctgctctaggcaagacaggaggtgaataggtgacgattcagatttagacctgaaaacacaacaggggtttatttgttttagaagaggattacccatatgacactttcagccagctgcccttagagacttaaaataagattgtatttaaaagaaaaatgggttttgcatgccttttgaggcattcagtggttctcatgtctcccctttgagcaatgccctgtacatcctggatggtcattttggcaggtaagctccagggaaaaggtaaaagtgctagggtgtccacactcctggcaagagccctagaaaacagggtaaacagtccaaagaggggggtctagtcagactgggctctggtagggacttgcaaagctaggtgtggcgcctccgctttgtaaccaagaacccccagttccttgtaatccccctcacaagttactacaggaagtgaggtaggaaggttttatggggacccaggcaggcaggaggcattctggggaaggtggtgttggctcaaatcctgggcctcatgtcccttctctggttgtatcttccatgctagaagagcacctctttctgatgaggagtcaacgacaggcgactgccagcactttggatctcaggagttttgtgtcagcagcagtttttccaaggtaagaggctttatggagccacgtgctgtccaccaaaggatggagctgagctgcctgggaggtgtgcccagcctgccatcccaggaagtgggcaggaagggacagggtctctcccaggagttggtattggtgggacacaaattggctggctgccctctgcgtcttccgagacctggttggtcgagttgcagagaagaccagcagttgcctctcgggcctcaggacacttgcaccatctgcagggagctggctgagatgtgcatgctatcctgtcgttgcaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcat

SEQ ID NO: 5872 - DNA, 66191 bp, human
ggttccgcgctggaagtctccgggggagtcgctgttgctgaggctgtcgcctgaggtttttcgcgctcctccctttcctcctcctctttctcctcctccttatccgaaccccagtcagaccgatctgctctgctctcggtaagcggcccccgcccccgcctgtgccgcgcggaaggaggcagcagctctcccgcgcggccgaggcagccttccccagagggcggttctgagggcggctggctgagggtctctatgccggtgcggatcgacgggggtgcgggggaggggacaggcttggcggcgtggtagctggtgggccaccatcttgcgccgggccctgaagggggagggttttctggaggtagagcctggcggcccgcggcgggcagtggtttcgcgggccgcggcagctgcggcagccttctcacctcctgagtcctgtcggtctgtttccaacccggtttgggcttttcattctggaggcaactccctttcgtcttttgtacggttgatactgatgtttgacggagacccgcccaccctcaagtctcttcaatcaaacgaaaagagacttgaggggattccgaactttcaggcatcagagaccctgtgaccccttctttctgcgcaggttccccccacacaggaccggtcattccatgcccacaaccttgttctggccaaagggacttcccttctctgtcacagaaatcgtgctctattccgttattgtctagaggataagagccctgaggagaaacgtggagttaaatacactatattctaactaggaggtttgcaggttttacttaaagagatggaaaaaattatgctgaggtatactcctgctctagagatggagggagttcctttcaacttctctcaggttttaatgcttttttaaggagaaattcgagaggaaattgtcaagtgaaccagcttctgcaagcacgggagaccttcatccaggggattctctttgtttggaaagatttgttagttttgtggagttttttaaatctgcgaccttaaattttttttactattgttttcaggtttggactatgagttgtaatgtcttttagtgcccctaaacataaaatagaaacctagaagtagagttttaaactgcaaaagtctcctcttagtatttgtgaggtgtcctggtttgggggttactgtgcaaacttaatctccttacgcagaaacttcactgagcctacaaaggcactgatttgcttgtaaaattagggctgtgtacctttgatgtttctacagcagtacagattccattataatcgtatcttgcatttgtatatttcattggtagcaccccttttgagatgggctgtagggtgtcgttagaactgtttgaagatgaggaaacagcctcaaggacagaactttaccgaggtcatgtgcctaggaagtgatggaaccaattcttaaacctaggctttctgaccctcatccaatgttcaatttggtatattatgtctcactttttgtgagagtgaggtggtcacggagaataagcaaggaggctcacttaaaagttttaagaagtattattcaattcctttttcctttatatttttatttttaaggcttcattttttttcgactttttcatactttaatattatttctaagcatgttgaagagttgaagaatatcctattgaaaaagttcttaggttgaataactccaaatctcagctacttggttttcagtgagtttgtcttaagtagtgattcaaaaagatttgatttcctcagtaattttttttttttttttttgagacggagtctcgcaatgtcgcccgggctggagtgcagtggcgcgatctcagctcactgcaacctctgcctcccgggttcaaccgattctgctacctcagcctcctaagcagctggggttacaggcccttgccaccacgcccggctaatttttgtaattttagtagagatggggtttcactatgttggccaggctggtctggaacgcctgacctcgtgatccacccacctcggcctcccaaagtgctgggattacaggagtgagcctccatgcccagccttcctcagtaatttgaatcaaatatatacgtctagactttttttcccagtgctctgtacattcagagaaacatcactagtaatgaactgtagaaatgactcctgaaagtagagtattcgtctagactttattcatttgctgcaaagtagttttcttttaaggagttttttttttcatttttttgtttcctttttaactttttattggcaaatgataattgtgcgtatttatggggtacaatgtgatgttttgatatgtatacattattgaaagaggctaacatagccatcaccttaccaatttatcattttgttatgagaatgttagaaattattttagcaattttgaaatatacaatacattattagtattagctgtggtcaccttgtagtgcaatagataactaaaacttattcctcccatctaattaaacttcgtactcttggatcaacatcttttccccatctgtcccacccctgaactcccaagtctctggtaaccatctttctactctctgtttctatgagataaagttgtttagattccacatgtgagatcatacagcatttttccccagagaataagagaatccagctgctttttattaagataaatattaaagacatttgcaaaaatgtaaatcaatattacttttctcattaaatttgttttttaaaagttattctcattaaaagtatttttattaacttgtaatgggcttataaatattttaaataaaaacatttgaaatctgtctcagtttcaatttctaatatgggaaatatcaacacatattgtccatataaacataaagctcattggggttctcattaagttttaagtgaaaagaaatcctgggataaaagagtttgagaactactgatgtgatgcagtttatttatgatatgattttaattgagctcttcatgtgaactagatttgttttctttaagtgcttgtattcatcaacttaacggtatgacttcaggtaaggaaggagaagttgagaaaaatagtgcaaagtactgttgaggaatatttcacttgctttatttaatgttcacagtagtgctgcaaggaaggtattactgttttcgttttacagatagaaaaactaaggcttacagaggttgattatacttacagatttggcagccaggaagtggtagaccagaaattcccactcaggttgtcagcccctatgtccagtgttcccatcaatgcacttacttacattttccctggtggataagttttactcgtataaaaagcaaattgattaataatacatacttcttgaggttactttaggaattagtgattatagaatatcttatgaaacttacataaaatatttactatacagattggcttcaaaaggccagtaattgtacattagtcttttccccatattatatcttttacatatgaattataataaaagcgtatgcctataaagtctataccctgagtataaagtaaaacttctttgtagaagtatattttattatagtgccccatcccaaagctgacataaaatgttttaaaatataggcaaactttgcaaagtattatgctagtgagttttaaatcttagtgtaaaccagctattttctacaaatagatgaagtatgaaaattaacagagacaaaagttgaaaatgaataaggataaaataataaagttattaaatgtcttctcaaaatgtacctggacttcatgtgttcaggctttcagaaaaaaagataatttgcatagtataaaaacttggacaaagaaaatatgaagagcctctattttctttctgaattgtatgtaatttgttcccaaaacctactttgaaagtttgaatcgttgagatgccagtcaaattgtctaaggaaccaagatataatccagttttcttggatttgcgtactataccaattcttgttataagaaaaacatttcacagacacccctgaacttaaaatgtttgaaacattctcagagttcttacacaaccataaaacaaagcagtcaagtgaaactacaaaaccattgccatttgaatcagctttcatatattgaatgagtattttgctgagtcactgcctacctacttctattgagtttttcatacctactgatatatactatatatataatatattccctacttatatataaataatagcaaggttttttatttgaaccctttcagtaccttcatttctatagctaaccatatggtcattgcccttcatttagtgcaaatgcgtcatttatgtatataaggttggtcacccagagaatccccagagcaggcttatgttaatttttttagatagcaaaagttaaatagcaaaacaaaaagagaattatattgttatagagctctcttgcacaacctggaatatatctattttcctgagaggtctgttgaccctggtttgaaaaatggggtaatccattgatgaatttattagtagttttaaacacagttgccagaaacctagctcaaagtagattaaaccaaaaatgaataattattttctctcttaactgaaaagctgttgtggataatttgcttcaggcatggttagcttcaggtatttaaatggtatcatcaggaccggtcgaatgtttacctactctccctttctctactccagaatcgtacagctttgctatctttgttaggttctttctttggtactttttctccacatcactcccaagcttaaatcctaccagctgattattttttctttctttctttctttctttctttcttttctttttttttttttttttgagatggtgtctcactctgtctcccaggctggaatgcagtggtgcaatctcggctcactgcagcctccacctcccaggttcaagctattctcctgcctcagcctcctgagtagctgagattacaggcacatgctaccacgcccagctaatttttatatttttagtagagacggggtttcaccatgttggtcaggctggtctcgaactcctgactttgcaatgcacctgcctctgcctcccaaagtgctgggattacaggcataagccaccgcacctggccttattattttcttaatggcattattgagatacaattcatatagcatacaatttactcatttgaagtgtgcaattcagtggttttagtatattcacagttgtgcagctagcaccacagttaattttagaacattttcatcaccccagtaagaaaccctgtacccattaacagtcactccccatttcccaccaaccctcccaaccatatgcagcctctactctactttctgtctatggatttgacatttctagacatttggtatgaatgaaatcatacaatatgtggtctttttgactgtcttccttcacttagtataatgttctcaaggcccattagtattgtaacatgtatcagtgcttcattcctttttattaccaaatagtgttcagttgtatggatatatcacattttgtttgtccattcctgagttgatgggtatttgagttgtttccactttttggctattgtgaataatgccactgtgaacatttgtgtgcaaatttttgtgtggacatatgttttcaattgtctgtctctaggagtgtaattgctaggtcatgtgataactctgtttaactttgtgaggaactgccaaagtgttttccacagtggctgtaccatttcacattcccaccagcagtgtatgagggttccaatttctctacatccttgccaacacttgtgattatctgtcttttaattctagccatcctagtgggtgtaaagtgacatccattaactatttaaatgtttttttattgtggcaaaatacatatactatttaccattttaactatgtcaatctatttttaactttttgtagaataaactcttgtaaaacatagttgaattttagatacataaaagctgaaaccaaaaaataaataggaattataattatttatacaggcagtcttcaaaaaaatgaatgggttgtgttcagtaggtgtttcctcagtcagttactcagaattcattttttttccctcagaagaacagtgtattaaacatgggtatagtgtctccacctgaatcggtagctgaaatatggggtgttctttcctcttgtgcctattttgatgccaactctgagttgcagaacctagagaccctctggagttgctattataggagctcttaagatgcccactgcatatctttgctggatattccatttctctgacagctgacttaatcccccatacaattccttcccttgccaccaaaattctgatgtggtgactttaggggtttttgtgatagttttagaaggctgcaatccttccccaaaggaatccatgaagttgtatgtatttgtttattttaaaaactggaactaagtatggtagtattcttttgacgtgtcgtcccatagaaattccatagctgcatcatccactatagtagtcgctaaccacttgtagcttttgagcacttgaaatatggctagagtgactgaggagctggatttttattttttaattaagttgaagtagccacatgtggctagtggttacctcattggatagcacagctttggactgaagttatggctctaatggcatctaaagatttctgactttttagagcatttatgagcgtaccaattgagactctttggtggctgcattgggcctcaaaagctatctctatagccataggcagtaaatatgacttgtttatatagactacttgtacatttagtaatcattttaggatggttatgccaataaatattttatatgatcatttaattaaagtgttaagccaggcacagtgatgttcacctgtagtcccagttacttgggaggatcacttgagcccaagagttcaaggctgtggtatgcgatgatgagtcgtgcttgtgaatagccacggcactccagcctgggcaacatagtgagaccttgtctctaaaacataaaaattaaaaaaaaaaagtgttatatgaatctcataggctgtgcaattgtgactttaaaaaattctgtgctcttggtagcaatagatccttaatgttgagcaagaatggtcatgtatttatctgcgtggcatatgtattaccttaattctaatttaggaacaagcactaactatccaagtagttgagtttaaagagatttgaatagtcagacctcaaaactagggacatttactgaattacagaattcactagagactcttgtagtagaaatccaaacatttatacaagtaacttcttttggagttaaagtaatattttcccctttgctctaattccgtccaaataatttggaattagggagtttgcttttgccagttggaagataaagacaaatgtggagactgaattagctctgtatatcctactttagatttctgatgtctgatttttaccttttttgttttataacttaaatagtattttaaaagtttattctgtatgtagaatatatggtatgttcagtgcacgagaactcaggatacaaattcctgttttagaaagcaattcacattttttttgataacgtttaatgtaacagctttttgaaaagcccaaagaaccgtagacggattgtaaacttctgaaggcaaggactatggcttattcatctttgtattttccctagaacttggcatactaccctgagcacaaaaggcaatgaacagttactttataatgaattgttttactacgcaatttatccaattacttttctgttacttttcaaaaaactaaaaatatctaaatgtatgtgttttcttatagtaataatatttctgaaatgtgaagaataggaatcagttaaagattaatgtcacttagcatttcagaattcagatttactaaaacatatattacaggataattactcatttttgcataaagatcccttttgaagtttatttgtaatctgataactccgattttttcaagtagtaaatgtttaatacatttaactatatgttaaatgtattcatttggaaatgaaccaattatggaaaatgaattacctgtgtgtattaaacatatcaaactcaaaaggtgggcttttgtaggagaaaaagactaaatttatgtgcatttaatttaacaaaatccacactagtagtagacatctttattttagagggtggaaaactgagacctagcttactgtcttgtctggagtcatatggtgagtgtgctggagatcaaaattagacccaaagattttggatctcaggtttcatgtttcaatacttggtgttacttaaagtgactcataacattgattgatgtcatgtgttcgtacttaggtgaccttgcaacttcatggatgacgacaaaccttttcaaccaaaaagtaagtatttctgctgtagttgatactaataggcatggtttttgtactgtaaacctttcaaaagaaaagattagagacagaagtgggcacattttcttaaaaacaaatattatttatttatttatttttatttttttgagacagagtctcactgtgtcgcccaggctggagtgcagtggcatgatctcagctcactgcaagctccacctcctgggttcacgccattctcctgcctcagcctcctgagtagctgggattacaggcgcccaccaccacacccagctaattttttgtattttcagtagagacggggttttactgtgttagccaggatggtctcaatctcctgacttcgtgatccacccgcctcagcctcccaaagtgctgggattacaggcgtgagccaccgcacctggcctgtttatttttaagacagattctcactctgtcacctaagctggagtgcagtggcgtgatctcggctcacagcaagctccgctgcccaggttcaagcaattctcatgcctcagcctcccaagtagcttggattacaggcacccgccaccatgcctggctaatttttgtatttttagtagagatggggtttcaccatgttggccagagtggtctcgaactgacctcaagtgatccacccacatcggcctcccaaagtgctgggattacaggcgtgagccactgtgcctggccaaaacaaatatttattaaagtaatacatattcctagtttaaaaaaaaatacagtaaacatgtcagtaatagatatgaaatgtttccttctcatccccagcgataactactgttgtaggtttagtatacataatcacaaacttttttctgtgcatagacaaaaaataatttctaaataagatcatactatatatgttattatgtgccttttaaaattttttgctcggtagcatatcttgaaattaacaatgacagtactcagtttaaaagaatggggaagacctatttatttgttcccataatatcacagtggtgtcaacatgaatgtaaattactttttcaatcatcagtatatatgagtctcccttgtttctttaaatctggcattgcctggctttacctagtttcttaccccatagataatcatgtgttaagtacctactacatatccaatacactactgtgtgtaggaggaaatacaaagaaagaaaatatgtttttcactctcaaggagcttactttggagttgaacatgtataattaaggcacactaagaaataggcagtttgagatcatatatattaaatcttgaattgcatagcatagactgtcagtgcagtaagaggttaaagaaaaacaaatctaatggtttgctgaggaagttataattgaactaagagttggaaaggggcaaagaatcaatttggggggatatctgtttgaagttagatacttattaatatggcattttcctgaatctctgttaccacttctattaggtagatattgtgctcatgttagaggtgagaaaatagattcaagtaatttctccagagtcacataattaaaaatggtgcagtgaggatttgaactattcaatttgatgtcaagtgcatgctctttccactatactcgaatgatgtggacagtataaggtaaggagaaagggtattccaggtggaagaagcagtacgaatgaggacttcaaaggacacaatgagtgcggtattttcaagtattcagaatatacaaatactgaaatatgaattaatacttttaattgtctgacttacaacattctatgtaatgttttttgaggtatttggaaaaaagggtcagttcataatattggttacatttgggagaatttgaagattttttgttttgggggtttctttgtttggtaggcagactactgaacatcaaacaatgttatgccaagccatgatatctggcatatctgtatagaagaggaaatcaaaatgttttaaaagaatggaaccaatttgttaagaggttttgtttgtgtactgtcctcaaatcattgttttcaagttttacatgttaaggccatgctaaaggatggccttaattttgagtcaaaagtagaaatggcattattttaatatagtaaaattactgttaggaatgactgcatttgaaaaacaaagatatcattgtctaagccagaaccctgaagaagttttattttgtttttatttattcttatagttgtccccgacaatccacatgtcactccaccacttatatacattcccatttttattatttattatttattttttatttttttgagacagagtctagcactgtggcccagactggagagcagtggtgccatctctgctcactgcaacctctgccactcaggatcaagtgattctcctgcctcagcatcccaagtagctgggattgcaggtgtgccccaccactcccagctaatttttgtaatttttgtaattttagtagagacgagatttcaccatgttggccaggctggtctcgaactcctggcctcatctcagtctaccaaagtgctgggattaaaggcgtgagccactgtgcccagaccccattgctgttacattagtttacatctccttcactattttttaacctaaacaatacacttatctttttttaaagtcaaacaacttgaaaagcctttaagttacttaagcacagtctcttgaagggagggagtgaaggagagagagagaggtagagataggtgtgtatgtgtgagcacatgcaggtacctatatactccctgttttttcaagctaaaaaactgaaagcatgtactttcagttgtatagctgtttttctaataattccacgtttctcaatttttaaaactcatatgtacatatgttgtctcttgaatcatcaagttttgccattacctagtgattttctgtcaaggaagatgaggattttggttttcttaaagctttttcttccttttaagcatctctcaatatagttatatctgaatttttcagtaaatcatattcagtgattttatgatgaccgtaatactgttcacgggtgagcatggtactgtattaatgtattatgatggatacatttccttttctctttttctatgtattgtccaattaaaattttcattttataagtcagcaaagtttattaaaacctatagccactcacacccttccagagcctttttttttttttttttttttgagacagagtctcgctcttgcccaggctggagtgcagtggcgtgatctcggctcactgcaagctctgcctcccaggatcataccattctcctgcctcagcctcccgagtagctgggactacaggcacctgctaccatgcctggctaatttttttgtgtttttagtagagacggggtttcaccatgttagccaggatggtctcgatctcctgaccccgtgatctgcctgcctcggcctccgaaagtgctgggattacaggtgtgagccaccgcgcctggccctctttcttttattttattttctgagacagtctcacgctgttaaccaggctggagtgcagtggcgtgatctcaactcactgcacctttacctcccgggttccagcaattctcctgcctcagcctcccgcctagctgggattaaaggtgtgcgccaccatgcactgcaaatttttgtatttttgttttcagtagagacaggattttgccgtatggaccacactggtctcacactcctgacctcaagtgatctgcccacctcagcctcccaaagtgctgggattaaggtcgtgagctaccgcgcccccccacttctttgtcccctttttttcttgagatggagtctcccagtcgcccagactggagtgcagtggcgcagtcttggctcactgcacttcccactcccgggttccagcgattctcatgcctctgcctctgcctcccgtgtagctgggaatacaggcgtgcaccaccaccgcgcccggccccatggcctcttaattcacttttcctgcactgaaacttgtcaggtaatctaacaatttaatgtttaatattttaataatatttagggggattggcaccttcctgggagtggtattctcctgcacagctcttgtcctgggactttcttttgtttttgtattgtgctcaatgtcagattttctgcatcctgtgccattctccttcttaagtcttgttttggtggattcctactaagaaagggggaatgagagggaaatgttgtataatattgctggtctttattcttattcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagctaatctttgtatttttagtagggacagcgtctcaccatgttgtccatgctggtctcgaactcctggcctcaagtgatccacctgccttggcctccgaaagtgctgggattacaggcctgggccaccacactcagccacctggcaatttctgatattctgaaatttcatatgtcccgctagtgtagtttttattcttgatcattgtgctggctgttagtgggccctttctttctgtagatttatatccatgagaactaggaattttttttgtattttcctttgattacttctcctctcctttttctctctcttttttttttttctggagcttttgttaggtgcattttatacctttgaaaatgatttttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgacagagcgagactccgtctcaaaaaaaaaaaaaaaaagaaaaaaaaagaaaatgatttttctaccaatcttgttttctgtgtttaatatatgtgttttttgtcttttggtttcacatttactcaactttgacatttgacttttttttttttttaactgaattttggctgtctttatataatatcgttgtcttatctgtctaaagatgtttattatatcctattattgtctcttgctctgtattatctgtgtcttctttttttaacttttattttaagttcagggatacatgtgcaggtttgttatgggtacactcatgtcttgggggtttgttgtataggttatttcatcactcaggtattaagcctagtactcatgagttatttttcctgatcctctccctcctcccaccctccaccctcaagtaggccctcagcatctgttgttcacctctatatgtccatgtgttctcatcatttagctcccacttataagtgataacatgtggtattaggttttctgttcctgcattagtttgctaaggataatggtctccagctccatccatgttcctgcaaaggacatgaccttgctcttttttatggctgcaaagttctccatggtgtatatgtaccacattttcttcatccagtctaccattgatgggcatttgggtcgattccatgtctttgctcctgtgaatagtgctgcagtgaacatatgtatacatgtgtctttatgatagaagagtttacattcctttgggtatatacctagtaatagaattgctgggtctaatggtagttctgtttttagctctttgaggaatcaccacactgtcttccacagtggttgaactaatttacactcccaccaacagtgtataaatgttcctttttctctgcaacctccccagcatctgttatttttttgacttttgaatagccattctgacaggtgagagattatatctcagtgtggttttgatttgcatttctctaatgatcagtgatgttgtgctttttttcatatgcttgttgcctgcatgtatgtcttcttctgataagcatctgttcacatccactgccaacttttcaatggggttgtttgcttttttcttgtaaatttgtttaagttctttatatatgctggatattagccctttgtcagatgcatgatttgcaaaatttttctcctgtctgtaggttgtctgtttactctgtctctagtttcttttgctctgtctatagtttcatttaattagagcccatttgtcaattttggctcttgttgtaattgcctttgacgtctttgtcatgaagtctttggccattcctatgtccagaatggtattggctaggttgtcttccagggtttttatagttttgggttttacattgaagtctttgatccatcttgagttgatttttgtgtatggtgtaaggaaggggtccagtttcagtctcttgcatatggctagccagttatcctggcaccatttattgaatagggagtcctttccccattgtgtgtttttgtcagctttgtcgaacgtcagatggctgtaggtgtgtggccttatttctgggctctctattctgttccattggtttatatatgtgtttttgtaccaggaccatgttgttttggttattgtagccctgtaccatttgaaggcaggtagcatgatgccttcatctttgttctttgtgcttaggtttgtcttggctatccaggccttttttggttccatatgaatttgaaaatagctttttcttgttctgtgaagaatgtcattggtagtttgataggcatatcattgaatttataaattgctttgggcagtatgccattttaacaatactgattcatccaattcatgagcgtagaatgtttttccatgtgtttgtgtcatctctgatttctttcagcagtgttttgtaattcacattgaagagatctttaacctccctggttagctctattcctaggtattttattctttttgtagctgttgtgaataagattgtgttcctgatttggcacttggcttgactgttgttggtgtataggaatgccggtgatttttgtacgttgatttgtatcctgagactttgctgaagttgtttatcagcttaaggcacttttgggcagagactatggggttttctagatattggctcatgctgtctgcaaacagggatagtttgacttcctgtcttcctatgtggatgccgtctatttctttctcttgcctgattgctctagtcaagacttccaatactgtgttgaataggaacggtgagagagagcatccttgtcttgtgctggttttccaggggaatgcttccagcttgtgcccattctgtatgatgttgcctgtgggtttgtcatagatggcccttattattttgaggtatgttcctttaatacctagtttattgagaatttttttttttttgagacggagtctcactctgtcaccaggctggagtgcagtggcacgatcttggctcactgcaacctccgcctcctgggttcaagccattctcctgcctcagcctcccaagtagctgggactgcagacacgcgccaccacacccagttaatttttttatttttagtagagacagggtttcaccatattggccaggatggtcttgatctcttgacctcgtgatccgcccacctcggcctcccagaatgctgggattacaggcctgagccaccacacctgaccgtttattgagtatttttaacacgaaggggtgttgaattttattgatagcctttactgcgtgtattgagataatcagatagtttttgtccttagttctgtttatgtgatgaatcacatttattgatttgcatgtgttgaacgaaccctgcatcccagggataaagcctgcaggatagtagtagataagctttttgatgtgctgctgtattcggtttgccaatattttgttgaggatttttgcatccatgttcatcaaagatgttggcatgaaagctttttggttttttgatttttggttttttcgttttttgtttttcattttttctgagatagcgtctcattctgccacccaggctgtagtgcagtggcacgatctcagctcactgcaacctccacctcctgggttcaagcgattcccctgccccagcctcccaaatagttgggcttacaggtgtgcgccatcatgcctgggtaatttttgtgtttttagtagagacggggtttcgccatgttggccaggctggtcttaaactcttgacatcaagtgatccgcccaccccggcctcccagagtgctgggattaaggtcgtgagcctctacgcctggctccttctgtcacctctgtttttgtttttgtttttttttttttttcagacgaagtctggcgctgcctcccaggctggagtgcagtgtttcgatctcagttcactgcacttccccttccgggttccagagattctcgttctctcctgggttccagagattctcattctttagcctcctgggtagctggaactacaggcatgcaccactaccgcgcccggccccatggcctcttaattcacttttgttacactgtgaaacttgtcaggttatctaacaatttaatgcttaatactttggaagattggctggtctcctggaaatgatattctcctgcgctactctggctgtttgctctgtagacctactgcacagctgttgtcctgggattttcttttgtttttgtattgtgccgaatgtcagattttctgcatcctgcattgtcctccttcttaagtctcgttttggtggattcttcctgagaaagaaagggtgaatgagagggaaatgttgtataatattgctggtctttttttttttttttttttttttttgagacaggtccttactgcgtttgcctagactaaaatacagtggtgccatcatggctcactgcatccccagtctcctggggctcaggtgattctcccacctcagcattctgagtagctgggaaagaagtacttgccatcatgcctggctaagctgttctttattattattattattattttatttttttgagacagtcttactctgtcgcacaggctggagtacagtggtgtgatctcaccttattgcaacctctgcctcttgggttcaagtgaatcttctgcctctgactcccaagtagctggaattacaggctttcaccatcaccctggctaattttgtattttagtagagatgggggtttcaccatgttacctatccaggccggtctcgaactcctggcctcaagttaaccacccacctccgccttccaaaatgttggaattactggtgtgagccaccgcatccagcaaagttttatttttttgttgtgtctcttccaggttttgttatcaggacaatgctggcctcatagaatgagttaggaaggactttcggtaggaatagtaccagctcttctttgtacatcttgtagaattcaagtgtgaatccatctggttctcacctttttttgattggtaggctctttttactggttcaatttcagagctcgttattattctattcagggcttcagtttatttctggttcagtctggggagagtgaatgtgtcccaaaatttattcattttttctggattttctagttggtgtgcatagaggtgttcataatattgtctgatgtttatttgtatttttctgggttcagttgttgtatctcctttgttgtttcttattgtgtttatttggatcttctctcttctgtattagtctagctagtggcctattttattaattttttcaaaaaacaactccctgattcactgatcttttgaatggtttttcttgtctcaatctccttcagttcagctctgattttggacatttcttgtcttctctcttagctttggaattggtttgctcttggttctctagttctttttgttgtcatggtaggatgttaaattgagatctgtctttttgatgtgggtgtttagtggtctctttacataatcccatatttctcagaagtcttgtttgttccttttcattcttttttctctatatttttttggctatcttagaaaaccagtcttcaagttctgagattctttcctccgcttgttctattccgctattaatacttatgattgcattttgaaattcttgtatgtttttcagctctatcaggtcagttacgttcttttctatactggctattttgtctatcagctcctgtattgttttactatgattcttagcttccttggattaggtttcagtgtactcctgcatctcagtgacctttattcctgttcatatcctgaattcttttttctgtcctttcagccatctcagcccccttcggaacccttgttggagagtgaatgcagtttggaggaaagaaggcactctggctttttgagttgtcagagttcttttgctggttctttctcttctttgtgggctgatgttccttcagtctttgaagtcactgtcctttggattatttttttcttctacctgatgaccttaagggtttgattgtggtataaggtagattcagtcaactggcttcatttctagaagattttagggggccaaggctcagcttacaactcctggagtgcatgctctaattttgtaggactgatattggacctctgcttttttctctggcttctcaaggttaggaactcactgtgctagggggactgaggtgctcgtggacctcttgtcccagcacgccaatgggtgatgccagccaaactgttttgtagggcagtgacagcagggcccattcttgttcacacatgccagtggcagcagcagcacagcagagtgcacactcatcagctgctgcagggtgctagtggcttctgcgtgggctttcgcagaagtggcagaggcagcatggctcaggggtgcaggggccccaggtggcaactgtgtgtatggtcatgctggtggtggcattagcatggggatggggcactggccgttgcaggactgtatgcactctttgtacatgttgatacaggcagagatggccgctcagggtgggggagggtccactgttctctgtgcgtagttacattctagtggcagtggtggctcaggggcagggtgctggtgggcacaggtcttgcgggctctgtgctcaccaaggctccgactacaatggtagtatggcagaggagggtgggcggagtgcactcccactggcagcaggcagggcagggtgcacatacacatatgttcttacggggcagggaaggcaagatccacttgcgcacatacgcactgactggcaaagtgatgtggagggtggccatggacccagggtaagctggagtggggagaatgagcaggtgggccagtgcatggccacaggggcaaccctgctggagctctccgctggtcaagcccggttggccagctcaggagctatgatgctggccatcagggcactctaggctgtactgcaagagggaatgggcagactggggctccaggagaggacagctgaccaaagagtgctcaggtcagatgggcaagaccaccctgcagagttcaggtctgacagttcccctagtgctacagtctcctatggaaacaagcagagcctagggggatgggcatcccaggctgtgcttgaatacagatgttcctgcaacaaaccctctgggctccactctggctcgtgtgctgcctctaccacttctctaagcagctctccctgccaactaaagtgtcagtggtgatcaaagggtcttctcctgccgggattcccagaggtccatggcaagagtgagttgttccttgccagttcaactcacccattcccccgtagtcattgggggccaggaaccaatccaggtgcacagtagccccatacaggcttcccagtttcctcccgcttcattctagcttctgtgtcttccctcagcccactcagcacctcccctttgaagatgtgttaagagtgcaccagttgtcccagtccctcggtggcagctgttccacctgtctgtatctagtttgccatcctgcctggctgtcggttttctttaaaatcctttaatctgttttattgctttggtgtttcacattgaaggttttcctcaattttctggtacgcattggttgtccacccatatttaagagtgaggcactaaaatgcttcccaggagatctgatttgggtcagaacttgtaggctggtgatattcacagtatattttttacttagtttcttcaaatgagaaatgtctaatctgtcctgaaacagaattaagtttcacttaatttccctattttcagtctagtacctcatgcctgctttgccctgtgcctgatatacctgaatctggttccgtttttctagtatatctcctatgtattttctcttattcttagtttatctcccttgtttatacaagtgaatttttttttcagataatagctacagtcttttttgtagatataatcatcctagtcctataactaaaactcactttggatttgatcctaaaatgtattggccactgtaaatgactactatccttcattatctatctgtctagccaagtttaactggtttagatcttagagatttagttctgagctcatttcttttgctaccatgtactgattacaaggcagagatggccgctcagggtgggggagggtccactgtagaccatgcctgtagtcccagctattcaggaggctgaggcacgagaatcaagtcagtaggctgggcatggtggctcatgcctgtaatcccagcactttgggaggctgaagcaggcggatcacttgaggtcaggagttcgagaccagcctggtcaacatggtgaaacccatccctacgaaaaatacaaaaattaactgggcgtagcagtgggcgcctgtagtcccagctacttgggaggctgaggcaggagaatcgtttgaacccaggaggcggaggttgcagtgagccgagatcacgcctgggcaacaaaagcaaaactctgtcacaaaaacaaacaaatatcaagtcagtaattgctattaggattattacagtgcatcttaaatatcatactatgtattgcacagaaaatatttttctctttgaaaataaagttagcttctcttctcttgaaaattagacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaagtaagcatttactttcagtgaagtaacgtttcataagatggttgtttctaatggaaaatatatgagatatctgtccttcatactgttgttcttctgtaaggagttagaggtaagagggagagtaaaggtcagtaagaacttgtgagaatcaaagcgggaatgtagttggggactggagtaaggaggtgaaaggttaaaatatcagatgtgagcaaaaggaaataactaagttaattgagggttaagatgacctgaacagcattgtaagccttctgagattggaaatcataatttttaatggaaccaagtagcctatttatttgttaatttttttttctcccttaaactcagatttacagaaaaggaagtgtttggaatacttttcttaaaatatcctgatatgctaaataagtttgtgttagtgtctgatgggggttctaatgtctaagcaactgcctcatcaaagtatcatcttgatatatgactataaaatgcataggtgctgcatgattatagaatctctggtctgtctaccagcatgtgctatagcctttggctacacccatcttccgcaactactgtttatattcatgaaggagggagggcctggttttccaacactatacttggacaatgcaggcagtcagcacacgtaaatctttttggctttctagcaaaacatgtccagtacctttgtggattgttagatttctgttagagtaattagacttggcattattacaatgttaaagtgaagatactggtgatgtttattaaaataaaatatctcctccctgtaatcctagcagtttgggaggccgaagtgggtacatcacttgaggccaggagtttgagaccagcctggccaacatggtgaaaccccctctctactataaagattaaaaaattagccagtcatggtggcgcgtgcctgtagtcccagctactcaggaggctgaggcatgagaatcgcctgaacctgtaggcagaggttgcagtgagccaagatcacgtcactgcactccagtctaggcaacagagcaagactatatctcaaaaaaagaaaaaaaaaaagtcctcaaatatgtctaaagtgcaagggacaacataactgaatttcaggagagaaagagggaaacagatcctttttcattttatttacttattttaggcctggagaagtcaaggaatgtagccagcataccagtcttctttcttaccatggcaatgagtaatagtgtggttaagagatgagttttaaattttctgaaatcctagttcttacttctcttggctctaaacttggaatagcatttctactcagttttatcagaggcagaataatttagccaattgaattctcagtatcatttcctgtggcaaattgggaggttctaagtggagagccacttaaattattaaatgagctagatatatttggcatatttattattgatagtagaatagaatattctcttattatttctagtcactgtgacaatttttatgctgaaatattaccatatttcaaaattattactcaaatcatcttattgaagcatgacaagattcaagttggatttatattgattgtagatgacttagcagtactcaaccaaaacaatgtgtattcgtttcaagagattctatcaaaaagggtattgggcccactagaatttcttttctatattgataacttagaatttaagtgattttattgatgttttatttgtgagctataaaatattttagcatatgggatctcatctaaatgtttatatagaaaaacaatgaaggcaggggaaggagagcaaaaaacttgtgattggtagactataaccaccaacaagtaaaaatagctcttagtggattgagtaatacttatcttgaatttctgaatgaaaacattatcaagttgtttgaggatatttttcttttagaagacttccgtaatgtttactcatagagtactgcatttctatgatcagaaagcaaccctactttggtgtgacccttcacttaatagaattgttttgtgagatctgattcttttctctctttttttttttttttttttttttaagatggagtctcgctctgtcgcccaggctggagtgcagtggcacgatctcggctcactgcaagctccacctcccgggttcacaccattctcctgcctcagcctcccaagtagctgggactacaggtgcctgccaccacgcccagctaatttttttgtatttttagtagagacagggtttcaccatgttagccaggatggtctcgatctcctgacctcatgatctgcccgcctcggcctcccaaagtgctgggattacaggtgtgagccaccccgcctggccgggatctggttcttttctactaggagagaaaaaaggaaaatgtttgaggttttatgggatttgttaatgctttgtgccttttcctgataaacaattttaagcaaatcactattcttccaaatttcaatttgactcctcagtaacctagaagttacggagttcatatgggtacaagggtgtgcagtcttaaaccgatccagagggttttgtgaggctcaaactgacttctagcgtagtaatagatttgaaaccccttacattaatcagatactctggaactccaggtttaatttagtctaatcagatactctggaactccaggtttaatttagtctgtagtctctgataatttcctattcagaactcaagagtaatggtacagaaagttaatccagtcagccctcccatcatgaaacttccagatttttagaggtgtgaatgtggcacagggttggggaagggtttgatttcaagtcacgggaatcagaatctgtacacaaccctgtcaccattaaaggaaagaaatatacttcaattattggttatgcaaagatatgtttttggaggaatttttctattagtatatatttcattcacataacaaattttaaaataaatataattttatagatattttgaacagaggccactccagctcatcttcaaaaggaataaagagtgagccacacagtccaggtacagtattactgtagtatttcaattttaaagttaaatattttgatataattggttgtatagaaatatattcaatatgttgtataattttaaaatacaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgtaagtgtttataaaattacacaattaattcagggacacattggctattataatactgagttaaaattgtgatctgtcagccgggcacagtggctcacgcctgtaatctttggtactttgggaggccaaggcaggcagatcgcttgagcccaggagttcgagaccagcctggccaacatggcaagaccacatctctacaaaaatacaaaaaattagctgggcatagtggtgcaccacctgtagtcccagctactcgggaggctgagatgggaggattgcttgagccctggaggtcaaggctgcagtgagccaagatcataccactgcattccagcctgggtgagagggtgagatcctgattcaagaaaaaaacaaaagccaacacaaacaaacccaaaaaattgtgaactgtcatagctagttaccatttcagtagaaaaataatccccatctttatgatataactcaaccaaaacccaaaataataactgcaggaattgtccaacatattaataaatcagctaatatgcttaaatacagtattgaaaactatactatctaaatatgagtgaaaaagtatgatcaggttgggcatagtggcttacacctgtaatcctagcactttgggaggctgaaggaggtggactgcttgagctcagtagttcgagaccagcctgagcaacatggtgaaaccctgtctctatttaataaaaaaaataaaggctgggcgcaatggctcatgcctgtaatcccagcactttgggaggccgaggtgggtggatcacctgaggtcaggagttcaagaccagtctggcaaacgtggtgaaaccccgtctctactaaaaataaaaaaaaattagccaggcgtgttggcgcatgcctgtagtcccagctgtttgggagtctgaggcaggagaattgcttaaacctgggaggcagaggttgcagtgagccgagatcgcacaactgcactccaacccaggcaacagagtgagactccatctcaaaaagacaacaacaaaataaaaaactaaaatgtattgcaacatgaataatgcataatggccacatttttaagttaataaactaaaacaagtgttcttaaattggaaagagtgttctgaagtcattattgcttattctgaaatcatactttcatagtttagctttaaaaacttttaataaaagtaatagataatgataatacttaacatttactggcctgttaatatgtacaagtctttgtgctaatcttatttaattcttatggcatctttatgaggtaggcacaatttttatttttttattttatttttttttgagacggtgtcttgctctgtctcccaggtgggagtgcagtcatgtgatctcagctctctgcaacctctgcctcccaagttcaagagattctcctacctcagcctcccgagtagctggtattacaggcacgcaccaccacacccagttaatttttgtatttttagtagagacagggtttcaccatggtggccaggctagtctcgaactcctgacctcaggtgatctgccacccgcccccccccggcttcccaaagtgtggaattacagacgtgagccaccacgcccagctgagatgggcactattattattcccattttatagttgaggaaactcaggctcagagaggataaatgattcactcaaggacacacagctggtaaatgatggatctggtatttcaatccaggttaacccagaattttaaacatgtgtatacacacatccatttatacatttaagcatatactttatttatttagagacagggtcttgctctgtcacccactctggaatgtagtagcatgatcatagctcactgcagcctccaactcctgggctcaagcgatccttccacttagcctcctaagtagctgggactacaggcatgcaccaccatgcccagctaatttggcttttaattttttttagagatggggctctcactgtgttgcccaggctggtcttgaactcctggcctcaagctatcctccatctcagcctcccaaaatgttgggattacaggcgtgagccactgcactcagccccattaagtatgtactttttaaatggaagcattgccttagagcagtggtgtacccttacggttccctaagtctctttcagggatctgtgggattaaaactattgtcgtagacatttgtgctcttcactgtgttgacattgtaaaactctccaagtgactgtaatgtgcagccagagttgagaatgacagacagatattctcgaatgaattgagaatcctacataaggaaattttatttaaaaatttaaatctatttcattatctgtatctcagttctttcaggcagggaaggagagtattattattatctcttttaaagtgagtattattattatctcttttaaagatatagcttaaggacacaggctttgtaatcaggcggaccttagttctgattccagctccttcatctgtaacaggctgggttgtactgggaaccttaactacgagaaattttagtttacctatttataaaatgtgagataatattaggtctttattcatactgttatgacaactattaataaaatacatgtactgtgaaagaggcaagtacattttaaatacataattattagtggctcttatttcagttggaaaggtaaataacttgaagctcagaagtggcttgcccaaggtaacatagttaaataaatggacaggtcttctgaatctcagcctcttgcctagtctgccttactgttacatttgttatctttctgaaatattttatgagacataagaaattcccaattggagaattatttaacaggttgtttgttgaataatgtgtctgctttccgaaattgtggtacttaatttatcagagatgtcacctcagaaaaggttgaaagtgttacctttattcagaggaacttctgttaactatttttggaaattgcaaacggatattttccacttttaaacttttaaataaaaaatatttagagaaaatatttactttgtggtaagattgcacttggttacaattaagtcatagtctaaaacctaatcatctctcaaagtgtaagcacaaaacaagcaagcaaaatctttatatcctcattataaaagtattgtgtaaggagggataggttagaaaagagacagggaagaatatatactgtattttgattttcgttttctgtagatggttagggtgacattagagtatatcagtcaggggaccatattaatatatatttgatatctattcctcatttttcactgaacattgtactgggaacattgttctttgtcattgggtatttcccaaaaacatgatgttatgtgatagtatcatttaatttatttagtcatttctttattgttatacatacaggttttcaatttttgctattataaatcattcttcattaaacattttcatttctttagcatagattcttagaaattgagtaattggaataattggaccaaagaatatgaactttttttaaaaagcccttgatatagatactgctaaaatttccttgcagaaaagttgttccaaaatataacctctactttgcctgtaatattatttttaaattttaacattttatttcaaactaattttagatttacagaaaaattacaaaaataatgcagagttcccatatactcctcacccagtagatgctaattttggcagagactaataattacctttgtgttttataccatattagtaattgagttattaagattctttatagtattgacatacagctaaatttatctctataaaagtttatgaaacaaaataattataaatttttacaggattttacaaagaattcacaagttggatcggataattcttcaattttactgtttgactcgacccaggaatcactaccaccatcccaagacataccagcaatttttagagaaggtttggtttagcactctttcataaaaattataaaaagagacttgtcgaatatacatatggaattgaatttctgttttgaagcccataccttcatgttaagtttttcatatattataacatggaatagagctaatcattcctgaatgcctttcttgggtgatatagaaaattgtatttagtgatagaatgttttatttatttctattaagttggctagcacatattctttgcactctttttcacttggaaccagccatggactgaacaatcttaatataatttctgtgagtcaaggaagtcccctgatgccttaaatactctgcgaaaacaagtagtaattatttggaagacacttaatatgagaaaacgtgcatggttatagttgatttctcaatatgctaatgtctttctattcaaataaatgatgtggatatgatagttaaatatgattatagagtagtattgtaaaatgaacgaactaaagaaacagtgatttccacatggtaagtactcagtaaatatactttgaagtaataatggaaattttccaattgaagtgttacagttctttgatgtccaccataacaaagttcttcattaacctaaaatagtatgccaataaaggaattttgtctcattgaaaaattccctataatcaaagcaattactattctctatattacctagtttgatatgtttcactaaatggaaagaggaacacaatttttttgcatatgtaattatttactcataaattagtatataacctttaccaaaccaaaacaaaaaaattatagtcatatgaatgccaaaaatattttcccatttttatattacttggtttgatattcacctatctaggtgtcacttatctagatagtaaaatagccaagaaccgaaacaaacagggagataaaacagttgttttaactcgggttttgcaaagcacatgatctttattcatggaaaaagtctgaattcttgaagcttccaaagggtaaagacagtgactcctactctctctctaagattaatacagcagagagtgggactttgtcctgaatagtaaataggattatagttgattgggaaggtacaggtttaagcctttattctaaagatttttgtggcttttatcaagtcatctaacctctttatacctcagttttctcacattattaaaatactttcatttttctcacataaagcatttattctccagacctgaaatgagccagccatttggatattcaattttaattcttgctctctttatctcagggcttctttgaggcccaaataaaataagtggaaagtgaaaaatgcattatcaattttaaaggatttgacaataaacagttgttagaatgataatcatgcatgataatatgtgctatatgttcagaagcatgattaatggactcctgtctaagatgatcatggagagttcttagagaaagttggatttgaacttgattttgaagaatgaggataggatttttattagcacagataagaagagttgaggtagggaacaccgcaagccaaacacaacacaaataagtaagctaaagggtcagaatttaaaactattgagctcaggttgattttatttaacttagattcatcatgcttaaaataagcatatattaaaacagtctattatccagctggttatataatcagttgcctagtccaaagtactagcactcattggttgttaaagtaacctaagcatctcagaaaaaatgttagtgattacacaaaaattagtcttaggtgccttcaatatagctggcagtaattatgtgctttgaggatggaaaaaatcatttctgtttaaggaaaaaatcatttttatctcaaagaatgaaacacagatttaacagaggaacccattaatgtaatacttactttcctggcatatatctactctactgcttctcctattaatgtacagttgtgagcttttaaaacacgacatgcagttttagaacccttatcacaaagtacaatcgtatattattttcaaaaatcacttttgctgggtctggttatagcctaaatagccccacatgtcttgggaatgccctgaattatataatcctttggtctttaaggtggtggctctcaaactcagaactatctttagcaatgaaattcttactcagataaaatttatgcagaaattaataaaacataaaagcagagtttctttatctgacatacccattacattttctaagatagacccattggattaaggggaacatactttgaaagtcattatactaactctaaaccttttcatatgaatgagtgaggtattatcattcaacattagttgtttctactttgtatatagggagtaaacaagataatttaaaccacctgttagtttgttcggtggaaaaagaaccaacttgaattttccattacacatcttaagttttttaaaaaacattaaaaatgtttctctaaacgtttggaataaattttttaaatattttacaaactcaaatgtatttaagcatctaaatataagttgatgtgtagaaacttagagtattccctgtgctataacttttatttattttatttagcttggaattttttggtctaacttttttcatgatacctgtttgttttctttatttgaaagcatttttagaatttgggtatataaagtttattttgtgaagtaaagatatgtagttcatagtagtagctgtttgtgcaatttctgcttgctcatataaattttaatcattctttattgtcatttgtatgatatgcttattaaattatattacctttaacttagttccaaactgtttttgctcagttttaaatgtaaagccattttggtagcagttttacataagcaatattccatactgaaatatttacaaatatctttctcactatttaaatctttgtaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtaaacatgaaatctgacatgtaaaaaaaaatagtattatttttatatacgttttagaaattgtgatgaattttaaaaccattattagtggtcatttaaggttttaaaaagatggatttgagtcttaaaagttcttaatttattgtaggtacaaatacctcatctccatatgatgctggagcagattacctaagagcttgtccaaagtgcaatgttcagttcaatcttttggatcctttgaaataccacatgaaggtaaaacttttttcaaagttcaattgttaaaaatgttttatagatccttgaaaatattgaaaattgatatacagtaaatgctggtttatccagatatttagagaagaaacctcgtattggcatttccatgtaacttaagttaaaattgatattcacaatgattatataagattttaaaatcctttccaatgatgaaatttttaaaataaagttatggatagaactggaagccattatgttaagtgaaataagccaagcatagaaagacaaatggacgttgtcactcatatgtgagagctaaaaaagttgatctcatagaggtagagagtagaacaatagttgccagaggctgggaagggtatgtgtggaggggtaggagaagaggaagagaggttggttattatgcacaaatatacagttagatagaaggaataagttgtaatgtttggtgcaaagtagagtgaaaaatagctaggagagagcacttagaatattgccaacgcagagacatggtaaatactcgaggtaatggatacctcagacatcctgatttgatcattacatattctgtgcacttaaaatatcacatgtaccccataataatttataaacattatgtatcaatttaaattttttaattaagttcatatgcagtacagtgtatgcatattgtattttatttttatttatttatttatttgagacagagtcttgctctgtcacccaggccggagtacagtggcacaatcttggctccctgcaacatttgcctctccagttcaggcgattctcctgcctcagcctcccgcgtagctgggattacacgtagcaccaccatgcctggctaatttttgtatttttagtagagacggggttttgccatgttggccagactggtctcgaactcctggcatcaagtggatccactggcctcagcctcacaaagtgccgggattacaggtgtgagccactgcgcctggcctgcattttaattttaaatgaaaataatgtacaaattgcaatattttattgactaaattatgacattcttcaaacttcctgtaaagcaggtgttttattaggtgcttaatcttttgtgtaaagtgaaagctccttttgtttaccttattttttgcccatggtgacatatccatgtcgcattaccctgtgaaaaccttatttttgcccgtggtgacttaatgcatgtcacattaccctatgaaaaccttagtcttacattttaattttcaacactcagaaataaacttctaatgatggagcatttcatatgaaatgatagttttaactcaatccataatatagtttatatagttataaatgaattctagctttctattaatataggaagctctttgaaattaggttttaggtaattttcacagtactaatagagtatgggattaaggtaacacgccacttaaaatattttagtagatattacagtattctgttatgtgtgtataaagatagtctgtattctctttgcatgcccagtgtaaatgacaggaaggggcaaaggaggcaagaaaaaagtcagtgttgattatatgtgggaaataagtgatgagacgagtgcaaagcaaagaagcaacttaggaaaaggaattgttcactatttcaaagattggcaaatttttattaaaattcagcattttacaaaaaaggaattctaaaattgcaaatacaaacgtctttactctgacgcaaaactgtattagagtctttggctgttttcacctccctgagtgtgtttgggaaaggggaatccaagtctcacattaccactgtttcccttgatatcttccaattctgtttcatggtgttgctctttaggacatagatgtatccatctcttacgattcattgtgggtgcaccctttagcatttttatagtgtcctttttgtctgttcagtgctttttgtttgatatcaggctcacaacccttgctttcttattgtttccacctgcctgttatattctttgcttatccttttactttcaaccctcccaaatcactttgtttttgttctttcttgctttcaccagagttttttcttttgtgatcctatatgaaaacttcttttcttttagaagttgagttaaacccatgtatattcattggtaggagaaatttaactggtctgataggtttaattggtcttagttttgtcacaatgctttgttatgctttctttgtccttttttttttaaaaaaagtctttcactttgtgattttaggaaagtttttcttttgttttccacccttgttttagtgtgtagtcttgtctttatttaacgctttatttagtatttatttagtatgtagtcttgtctttatttaacactttattgaggtatgattgacctataaaaatctgtatttaatgtatacagcttgatgagtttggagctaagtatacatccatgaaaacattacaatttgtgtcataaacataaccatcaccttcaaaagtttcctcctaccctctttattattattacctttttgtgatatgaacacaatagaaaatctatgcttttagcaaatcttttttttttttttttttttgagacagagtttcactcttgttgcccaggctagagtgcaatggtgtaatctcggctgaccacaaccgcaacctccacctcccgggttcaagcaattctcctgcctcagctttctgagtaaccgggattacaggcatgcaccaccacacccagctaatttcgtatttttagtagagatggggtttctccatgttggtcaggctggtctcgaactcccaacctcaggtgatccgcccaccttggcctcccaaagtgctgggattacaggcgtgagccactgcacctggccaaatttttttaagtatgtaatacagtattgttaactatatatgcactattctatatagtagatctctaggacttattcatcttgaataactgaacctacataccttttgactaataccttcccattttcccctccctctagcccctggcaatcacaattctactctctgcatctatgagtttgactattttagattcctcatataacagaaatcatgtaatatttgtctgtctgtgactgtcttattttctttagcatgttttccaaatccatacatgttggtgcaaataagatttctttctgtttttatggctgaataatatttcatttgtgtgtgtgtgtgtatatatatataccacatcctcctcatccatttgtatattaatagacatttagattgctttcatgtcttggctattatgaataaccctgcaatgaagtctacctacatgggagtacagatgtctcattgggattccgatttcaattcctttgggcatatatacagaagtaggattactggatcatatggtagttctatttttaactttttgagaaacctcccatgtcttccatagcgactgcaccaataacattcccatcagcagtgtaaaatggttcccgtttttccacattcttatcaacacttatcttttgtctttttgatatagctgttctaataggtgtaaagtgatagctcattgtagttttggtttgcattttcctaatggttagcaatgttgagcacctttgcacatatgtgttggctactcataagtcgtcttttgtctattcaattccttgtgcccatttttaaattagtgtatttggttttttgctattgagttgtaggaatttctcatatattttggattttaaccctttctcagatagtttctcctatttttttatccagttattcttagagaattcttctagagaaattctacaactgtaaaatatatacaataaataaattagtttcatctcattggataaaaaaggcttatatatgaaagtattccaattaggatcagtttatatgatgtcttgattttattcatgaggtagatttccccttcagatatttaggcattctagatagaatatgttgagatattcaaaatgtaactgatgcttttttgtgtcccacacattttctagcatggtaagtctggagaatggcaggttagctgtgctcaaagtctagttccaaccaggcttcacttaaatattactgtgttatttgataatcaagcttatacataatggcatgtaaaactaccttttaagcttttttttttttttgagacggagtcttgctctgtcacccgggctggagtgcagtggcgcgacctcagctcacttcaacctccgccttacgggttcaagcaattcttctgcctcagcctcctgagtagctgggactacagacacgtgccaccacgcccggctaatttttttgtatttttaatagagacggggtttcaccatattggccaggctggtctcgaactcctgacctcgtgatccgcctgcctcagcctcccaaagtgctgggattataggcatgagccaccacacccagcctaagctattttttttttaattattgtagattcaggggtacatgtgcaagtttgttaacaagggtatattgcatgatgctgaggtttggacttctactgatcctgtcacccaaatagtgaacatagtacccaataggaagtttttcagcccctgccttcctccctccctcccaacttttggagacctcagtgtagtttccatctttatgtctgtgtatacccaatgtttagcttccacttacaagcttccacttataagtgagaacataagatatttagttttttgtttctgtgttaattcatttaggataatcgcctccagctgcatccatgttgctgcaaaggacgttatttcattcttttttatggctgtgtagtattccatagtgtatgtgtaccacattttctttatccagtccactgttgatgggcacctaggttgattccatgtcttcgctattgtgaatagtgctgcaatgaacatacaagtgtaggtgtctttttggtagaacgattaattttccagtgagtatatacccagtgatgagattgctgggtcaaatggtagttccatttttagttctttgagaatctccaaactgtttctacagtggctcaactaatttacattcctaccagtggtgtataagcatgtaagctgtatcttgacacagatatgaaatgggtgattttgggccaagaaaaatattattattaaatatttacatctaaaaagaaaaattgcaaggaaaaaatattagatacataaacatcccctgatcttaaggttttcaatattgtttttgaagttattcctttattaagatagtaggtgtttattgtttgaatttttttagaatatgtaaaaatggaagccacaattttggtcagtatctttctagatacattgccaagcgtagttttatatcatctgaccttagatgtaaacacaatcattttttggtatctaatctttaaaagagctgtagacaaggctcatatttttttcctctttcagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtatgtaaatatttatttttatttctgtttgaaagttgggatatgacagataagaatatagtatctttacattgctctgccatcctcggtaattaattctaatactttctactaagaacagtggcagattatcatgttgaaaagcttttgttccttcttgtattttaagagtttgactccaggatccacctagttgttttgttttcagatagcttaagaaaagacaaaatgtattttaatttaggggaaaactacttattttccctacatttattactgaactagacggtttcatgaaaaacttatattttctagctgactttgaatcttacttttcttcatgtcacaagaagaaccctatgcagcatgacctcctccatactaaccttatttaaagctcaaatttttccattttaaaataaattgcaggcgtttaccaaaaccaaagagaagtgttttggaggtgtgaaaaaagataaaaacccaaaccttcacaatgattgctatgtaggttgatgacattatcactttgtttcaagattattttctttagtgattcataataattgtaagtagttgacccagtcttaaaactgttgtttacattgaataactttactttgaaattcagcaaaaagttttagtaagccctttgaaaatggtatgtccatttatattgtactctctgccattgaacatcatagttccttctcttcagaagcctttcagagaagctaaaatagcagaaggtaaaactgaaaaatagacagtgctacaaagggcacagcctgctaagaaaaatgaatagtttgtgctaacagtaagccagtataattagataaaacaaaaggttcttgtaattatagtcattaaaattgctattgcatgcatttagaaaccaagacacaaataaaaatataccagcagtttgtcttttgagcagctgaaaccttcagagctttcaaagatttgtctcttcactgtagctgcttttggtggtagagtttccatcctttcagtattttattttaaaatgtaaatagtatttcatgtatggaaaagaagcctgctatttttctttgctaaaaaaaattttaaatctaaaataatgatatagtgttacagcaaattagtgatgtttcatactactacattaatggattattttagaaacaaagataaaaaaaccttactgagccacttaatgaaagtaaattatttaaagtacacactttatagagtgctttcaggccttggagatgttattttgagtcatagaattacattttaaaaatttattttcagagacttatttgtgaggtttttctttggttataagtctgaatttttgctcttactggcaaattgtttgtaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctagtaagtgaaagtttctttggaatcctgaatattgttgactttgatcatccgaactgtgaggaaaccttaaaaattctggcagaaaaaaataagaagtagactttgtaatatgagggcaaaattgaaaaaaaaaatcataacttttataaacctagatgaaatgtgttctaaagccaggtgtgatggtgcatgcctatacacccagctactgaggaggctgaggcaggaggatcacttgagcccatgagttcagtactatagaatgctatgatcaattgcacctgtgaatagccactgcactccagcctgggcaacatagtaagaccctgcctctacaaaaaaaaaaaaaaaaaaaaaaagtagaagaaaaaaactgttaaaattgaagtcccttggtcgggcgcagtggctcattcctgtaatcccagcactctgggaagccgaggtgggttgatcacctgaggtcgggagttagagaccagcctgactaacatggagaaaccccatctgtactaaaaatacaaaattagccaggcaaggtggcgcacgcctgtaatcccagctacttgggagactgaggcaggagaatcacttgaacccaggaggcagaggttgcggtgagccgagatggcaccattgcactccagcctgggcaacaagagcgagactccatctcaaaaaaataaaataaaataaaataattgaaatctttcttataaacaattcattagtggaaacttccttggcacatgcattggtgtaggggactaaattagaacacccagattccatggttttcaaatttgaagttaattgtcttgatttacactttagacaaaagttaactacaatgttaagatttagagtctgagacgcggacaaatttggttcagattccaactttgcctcttactacagctgtgagatctcaagcaagtttcttaatttttctgtgcttctggttcctcatctgaaaaataggaataaaaataacagtaccttcctcagtgatgttacgagaattaaataagctaatatatccttggaacagcattacagagtcaacagctatagaattgttagaaccacatcactgttacttctactattattattacttgttgtggatgtacaaaatgaatctttttttatatacatccttaaatggtataatgtgtttttttccactttcagctatttgcaaaatctgtgaattatcatttgaaacagagcatattcttttacaacatatgaaggacacccataaacctggtgaaatgccatatgtttgccaggtacacacacattttattgtgtagttaagtgtttgtttaattttcatgtgccatgaaatagtattgttcttttgattttttaaagccatttaaataaaattagttactatgctaaaattgaagaccctcttcattagtggaaacccccttgggtttaactcatgcattgtaagtaaaggggtggagtagattttgcctgtgggttgtagtttgctgacctctgtgctagatgaggaaatgccctactagagaaagacaaatgtgtgggttatcatatagggaaaattatagatatgctagagaaataggaaaatctcttagttatagaataccaaattaaatgctttgggatcagtgttccagaatttgaagtggcttccagtaacgaggaattgagatgaagataaattgacactggcatagcatggatgctatttaaaatctaaagaagagaatactctgttttatatagcaggaaaagctttttagaacaatatttggcagaggttgaaaattcacatcaagatagggggtggtagatttgaaaagaagaagagagtcttactgtgttttggaatatatgcctaaactttgaaagatatctttcaaaggttatctttattacttgcagtaatatgattcttggttgtataggcagcagagctggactagtagtacatgttcttccaaacagatgacccgttattgctactttgattgtaattgcaagaagttataaaatatcaagttaaactaagccttctttatatttctaggtttgccagtttagatcatcaacattttctgatgtagaagctcattttagagcagcccatgaaaacactaagaacttgctatgtccattttgcctcaaagttagtaaaatggcaaccccctacatgaatcattacatgaagcatcaggtgagattaagcagttcttatttgttcatgttgtcttagtgaaaagatatagatctatatgtatagatctatagctacatctatatctatctataacgtagaacattggttagatttgttctggacagaaagcaaagttgttctgaatgacacaattaatttataatttatgctgaataacttgtgaaactttcacttattttccttgcttgctttctggtgacactgagaatcataaatagtcaaagttctgaaagatagctagaaataggaaccccaaagtggaggaaaaaacagaagattcatgaaatatttaggttagatatttcaggacctaagggtggtgggactgggaatgactttgaaggtgcttatcaagagcaggaaaaagaataagtttgaatggaggaacataagattaaggactcataaccttgtattttcctctttctcttgaaatcttatttctactttctagcccactttttattatgagacatgtggttgtcatcagtgacccagaattgacttttgtagcagccagtaacaaaggaaacagcaagaacacttatgaccagatatgtgaactatactagagaactatatttaggttataacttacttactttgtgacttttgccagttctgctatataatttctgggataccagtattgatgcttgcatctttcccttgaattctgattttatgcttactgattcttttcctcaattagagcatcctgtgggctgaaaactttgatgaaacagtgggcctattcttgagtgtttgaaacagcaatagtgcctttgccaaaatcagaagtcaacggatttactaagtctggtcatgtaatcaagttttgcctcctcactgatcagctcattacattttcgtagtattgattgcattgtctcggcaagttgattcagtactggcactaacgtcgcccttgaatgtagtcattggatgatcatgaaatcaacttatagttgttaattggaaaaaaagtcataaaaatagaatttccaaacacattcagattacctgtgttatgacttggatggtatcagtgtcttttttttttttttttatcctggtaggccatctcacccttaaaaactttggcaaaatctttctagggtttccaccaacagtgttcactcagatgttaataagtgttcccctcttaacttgttcctggtaaaagaaatttagtgaatggctggatttacaaaattcatagaggtgttttttgtttatttttaacaacaagacttttcagagcttttaatatgctaatactgtaaatctctaagcaagggacatagtgtgtaatagtcctcaaacatttttaacctttgagccctttatttgcacaatacctattaacatttcttgaggtatagagtttgggaaacactattcttggtggtctgtatttcattttttggccttcaattttgaaaagaagaatggaacataaagcagtatctctgactgtctaattatgggttttttaacataattctttcccctgtgctttactaagctccagagtgatatagatgtagatttgaagggagtgataacatgcttagaaaggtaagaaagacataatgaacccactttgtgagctgtgtcttataagtggtttatctgatctgtagtcattcttcatatcctaagttgtatgccttaacttgctgtatgtattggaaagagttacccaacaggtctgagttgctcaaatattgcacaatttcagaagtgcctgcttgtataactggcccttggctaaatcttggaaattgagcttctaaaatgttctctatgttattaactgataagagtggtttacatgcctggaaccttgagccatgttgtaccagttagtcaagaaaattcgcacaaaaaaatacggttatggtgaccacctgcttttcttgcagtgggaggagtcgtctgaaaatttggtggcttacctccataaaaaacctaagctcttagactcaagagagctttcccatcaagcaacactttatacgtgttgctgcagttcattgctgagggattttatacatgttgctgcagttcattgctgagggattaagtgtgtcctatgtgactccattggaatagagctcttagaagttggcgcctggtaatcctctagaagctatccagtacaccattttcctttattaatcctgctctgtacccttacactgtaataaaacatagctgtgagtataacactaagtcctatcgatccttctgctgaatcatcacatctgggagtagtctgagggaccactgaggtgccacaggtgctgtcttagtctgtttgagctactataacatgctattataccattgactgggaagcttaaacaacaagcacttatttctctctgttatggaggctgtaaagtccaagatcagggcaccagtggttcagtgtctggtgaggacctgcttccttgttcatagatggccatattctcactgtgtcttcacatgggggaaggggtggagagggctctctagggtcccttttataaggacactaatcccatttatgacagctccaccatcataatctaattagtttccgaaggctccacctcccaatactattacattgaaaattaggatttcgccatatgaattggggggcggaggggacacaggcattcagtccatttcaggtgctgaatttttttgttaagtttggagtacctgaagagtaaacagtcagcagtgaagaggtaagattctattgataagaaggatcatcaggcttctctgaaggtatttgcagtttgcataattattcacaaaagactcaaaaacctgagctgaccaatattataagcttataatttagatggcattagtgcaattttatgtaataagaattattgactctatggtttattttattctttttgaaaactttgattgcaactttttcctaaaaataatatattattatgtcttgagtgattttggagttagcaatgcagtttatacattttttaacaaaggacgaaagactccacatgtgttaaatatcctcattagctctttaataacaacaataagcagttaacatataataatcacttaccatttgacagccactggtgcttttacatgcattatcttgtttaatcttcacagccaccctatgaggcaggtatatgattgttttcattttatagatgaggaaacaaagctttatagaaagtaatttgcccagtgtcacattccctaacaaatggcagagcccaaaattgatttatagcccaagcttccaccgcagactcatattccacattgacattaggtctaaaggcagaaattacagatagttacccttgaaaatccctcaaattggccaggtgcagtggctcatgcctgtaatcccagcactttgggaggccaaggcaggcggatcacctgaggccaggagtttgagactagcctggccaacatggtgaaaccctgtctctactaaaaataaaaaaaattagctgggtgtggtggtgcatgcctgtaatcccagctactcgtaggctgaggggggagaatcacatgaacccgggaggcagaggttgcagtgagccaagatcatgccactccagcctgggagacagagcaagactccgtctcaaaagaaaaaaaaattcctcatataacccaaaaaccatatagtatgcatgtcaagaagttcaacacttaactttttctctacccttggaacaagttactgtttctttggttaaacattattttaaaaatgtattagttgggcacagtggctcatgcctgtaatcccagctctttgggagaccgaggagggtggatcactggaggtcaggagttcgagaccagccctgccccatctctaaaaatacaaaattagccaggtgtggtggcaggtgcctgtaatcccagctagttgggaggctgaggcaggagaactgcttgaacccaggagacggaggttgcagtgagccgaggttgtgccattgcactccagcctgggcaacaaaagcaaaactgtatctcaaaaaacaaaaaaaagtatcatctgtgatcattagcacaatgcaagcatacatacataagagggatatccaggacttgagtccaactaagggaatagtagattaatgtctcccatcttggggctctggacaagtaaatactcattgaatgaaatggcagacactttgaactagttaaattgtgcctgctgctcatttgtactctgtcagtctcttgcctcactttatttctttatttaagaaatatttgagtgcctaatatatgccaaggactgttttaggtactggggatacagaagtaagcaaagcaaggtttgtactcactgaaataatgcatcatggtagagaagggtgtgtgtgtgtgtgtgtgtgtgtgtgtgtgtgtgtgtgtgtgtgtgtgtgtgtggtgtctgaatgtatatgtatgccagctgatggtaagtaccatgggaagaaaatataggtagatagagagtgccagggctcaggtgaaggagtggtttctgttttttaaatggtgtggtcaaagagggcttctccaaagggaataagagagtaagtcatgtggcttactcatctgggagagaatgttccaggtagagggaacaataggtaggcagtgaagtgaacatatacctaggatattcaaggaagagcaaggagaccagtgtggctggagcacagtaaacaagtgagaggaaaagtagtaggagatgaaattgtagcaagagaatgtaagccagatcatttgaggacttgtaagccagagtcagaattctggagtgttacggaaagccatttggagggtttaaccatgtgaaagatctgtaacattttaagatcactctgacagctatgggaagaacagactaggagaaaggatggaaatagggagaagataggaggctcttgcaagagtccgcgtaagtggctcagacaagtatagtagcagtgattggaggtgatgagaaattgaaagattataaatttttttttaaggtatcactgacaggttttattaatttgttgaatgtgggatgtaagagaaagagaagagttaagagtgaccaagtgttttttgtcctgagcagctgcaagaatttagatcccatatactgagatattgggaagagtagggaaggaacagattttgtgcccttccccactcgggatgaatgagagggaatctagagttcaactttttgtccatgttgatttgaaatacctattagacatcaagagatgtcaagtaggcggtgggtggatgctatttaaagccatgaaactgaatgaggtataggtataggtagagaaaaaaattgtgggaactgtactctgcgggaacattctatccatcatcttaatttgctgtctattacttagctgagattttcttctttccccttctctcttgagcacctacaggtaaatctgtttgtgtttactgtacctatggtatgatccagtacaccacacttctaaaatagtctgaagatcaaactaaaatagtaatgcaaacaccttatctttatatattgctttgaactttgtaaagagcttttatttagcaaatgctttttatgcaccagtaactactagatactttcatacatgttacctcgtttggttttcctaaaagattgtttgtgttttatatgcaaatgatgagctggtggagatacatctttaaagaaagctttcttttgtatttgtatgttgttctaaatttataataaatataaaatatattttaattaataagaacatatgcataaagatggcaattgtatagtagacagaacactaaccagctatgggcaagtgcaaatttctcttgggtcccatttcccattggtaaaataataatggggctaggtttgaggagggatttagtcaagggtttctcaaacaatagattgggatccactcgtatttatgcctctataatcagtatagaacttttccaattaaaatctaattatatactttttatgtttgatccttatatggtaactaatgcttttgaaactcaaatactaacacaaggagtacttttaaataatagatcactttgaattgtctgtggtgggagatggtaaaattctggttgtaaatttatttagattttagaattaagagcaatttcagctcctaggatttgtggtggtggaagttattatatctaatattttctgtaaacagaaaaaaggagttcatcgttgcccaaaatgcagactacaatttttgaccagcaaggagaaagctgaacataaggcgcagcatcgtacatttataaagcctaaagaactagaaggattgcctcctggagcaaaagtgagtttgtgagggagtttttggtggttttttgcacattctattaatttttttatgtttttttttttattatggatagaaggaataagatctagtgttagaaagctcactagggcaactatattaacaataatttattgtgtatttcaaaataactaaaagagtggaattggaatgtccctaacacaaataaatgataaatacttgaggtgatggatacccgttaccctgatttgatcattatgtattgtatgcttgtatcaaaatatcccatgcaccccaaaagtgagttttaaatatgctgtatttttaacattttgtatgataatagaaacaaactactgcctggttttatctattgaatataatattaaaattgacctctgattgttattaagactttaattttaggttttatcattcttatgcttgtaaagaaaaacttctaaccattgttttttttagttgattgatgtggtttgttggagggatatttctagtgcaactagattgtagactaagttggcaggtcgtttcaatgttctgtaggctgtttttgagctattccagttgtcagtgtgtatgtctttttcagttgctagactataagatatttaagatcaggaattatatttaatttatctttgtgtccccagcatctgtcacagtgccttgaatgccataggtttgttgaagttagtattactaatctactctcagagaagcaagttttgctcctggatagcatagcattgctgtttttcatgagcaagcacacatcagactacaaatttctttctccttctttgccttatatacatatgttttcgctgactttttttttttttttttttttttttttgagacagagtctcactctatccctcaggctggagtgcagtggcgcgatctcagcttactgcagcctccgcctcccgggttcaagtgattctcgtgcctcagtctcccaagtagttgggattacaagcatgcagcatgatgtccagctaattgtttgtatttttaatagagactgggtttcgccaacatggccaggctggtctcaaactcctggcctcaagtgatctgcccgcctcggcctcccagagtgtggggttacaggcatgagccaccacgcctggccctctgacttctttacataaagttagctcttgaatattttctccagtaaagagatagataatccaaggtgagataatccctaaacatttgtatttcactttgagtacatgcttttgaatgcgagtatgtctgctatttaaattaacaaaattaatataaaacaattatctgaatatctagcataagataaaccatctggcatccttccctgcaatccatttgttccatgttggtattagacatgcagaatattaatgtaggcagtacaatcctctctcacatcttcccttattaataagataccaatagtaatgataatattgataataatgatactatatgtcttatagcactttagaattaagtgttcggtgtgcctttccatacattttattatttaacctatgtggtgatccagtgatatagacaaggcaagtattatccccatattagagatgaagaggctcagagaggctaaattccttactcaaggtcatgtagctaggaagaggtagtactaagattcttaaactcaggtcttttgacttctactctagtgctttcaaaacatgtattttctttttgcaagctaacaagttctgcttcagtgcttttctataccacatatatttcataggacttcatagaagctgttcttcaagtacatggggggagtgtaatcaaatgattaaagaaaatgttagtggatgacttttctattattaaccaatagatacaaacattttctttttccaaatagtaaatgataaattttatatgttaccattaaggaaattctgagcattattataaccaccatgctgtgtgatgaattgatataagctcaccataaccttggaagcagaaatcatgccccctgatcccccaggaagaggtcacatttactgaaaatctgttttatagttaccagagggtaatgcaggcctttccagagttattatttcagacctctatattacattttgacctctctatttgtgaaagccttttagttagttgggtttttttgtttgtttgtttttgagacgggggtctcactctgtcacccaggttggagtgtagtggtgccatcttagcttactgcaacctctgcctccgaggctcaagcgatcctcccacctcagcctcccaagtagctgggaccacaggcggatgtcaccatgcccagctaattttattgcatttttggtagagatgagttgcccaggctggtctcaaactcctgagctcaggcagtccacccaccttggcctcccaaagtgctggggttacaggcatgagccaccacacccagccctttttaattctatcaaagcataaaatagctatggaatgtgctcttttgatatttatctaatttttactcctaattattcgttaatatctgttaacatacaactgttatcaatataaaactaatattacaacagtaagtaaatatcaagataaatttcatttaatcagtatgaccatttagaataagtagaaggcttatctgattgtagtttatacttgccattttcaaaataatgattttaactttttgtattgcagtggttttttggtaacagtgttattgagatataattcatatatcacacaatttacccatttacagtgtacacagttcagtggtttttagtatattcagatttgggcaaacatcactacaataaattttaaaacatttttatcaccctcaaaagaaacctcataccctttagcattcactatttcccctccattagacctgtgcaaactttagtctgcttttagtgtctatggattttcctattctggacgtttcatataaattgagtcatacaatatgccatctttagggactggtttctttcgcttagcataatgttttgtaggttcattgatattgtaccatgtttcagtacttcattcttttttgtggctgagtaatactccactgtatagatattctacattttatcctttcatctattggtgggcatatgggttgtttcctctttttggctataatggtgctgtaaaaattcatgtacaggtttttgtgtgaacgtatgttttcatttctcatgggtatatacctctgagtagaatggctgagtcaaatggtaactcttacctttaatattttaagaaactgccaaactgtttttctttttttgttcttttgttttgttttgtttttgagacggagtcttgccgtgttgcccaggctggagtgcagtggtgcgatcttggcacactgcaacctccgcctcctgggttcaagcaattttcctgcctcagcctcccgagtagctgggattacaggtacctgccaccatgcctggctaattttttgtatttttaaaagaaatggagtttcaccatgttggccaggctggtctcaaactccttacctcaagtgatccgcccacctcggcctcccaaagttcagggagtacaggcctaagccaccacacccagcctgccaaactgtttttcattgtaactacactgttgtgcattcccaccagcaatgtatgagggttcgcatttctctatgtcctagccaatacttgttattgtctgtttattatagccattctggttggtgaagggacatctcatttgggatttcatttgcatttccctggtgactaatgacgtggaccatctctttgtgtgcttattggccgtttgtatatcttctttgaagaaatgcctattcatctattttctctttggttgcttgtgcttttggtgtcatatataagaaaccgttgcctaactcatgctcacaagaatttactactgtattttcttctaagagttttatagttttaccttttagaatttggtctttaatacattttgagataatttttgtatataatatgaggtaagggttcaaattcattcttttgcacatggatatcagtttttgtagcagcattcatcaagactattttttgccccattggaaatgttttgggacccttgccagtttaccgtaaatgtgatatttacggcttacaatgatatttttaatactaatgcgatggttacttttctaaaaatatgtattggctttgtttttataggttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtaatatcttttattcctgatatacaatacaaatttaatcttatgtatataatttatcatatcataaaaccctcttacacatttacatgataatcacttatctggcataaagaccaagcaaatgagaaaaaggtactttttacaactgctgagcagaacttgagtcattgtgtttattctctaattttcatcttttacactaaacttatattttgtgcttttatcttatgatagattaattggtttatttgatcccttttattccagggaaatgttaactggtgttaaattttttacacttactctagcttgtttcaaagcaaattttgaaattatgagtctacttaaagataccaatttaaacattttggcttcagttaataaaatgttaataagattttcccctgttatttttgttttataatctctttttatcttttttttccgtctccataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgaggtaagttaaacatgtaaactgccaatcagaatttccatttgggtcatttgttttttgaaaacagagttatcctattgaaagcaagtttgtctcatcaaggaactaaaagggtctagcaatagggaacttctaagatgttccttgtactattttccagcatagtaactcataaaattactgggacaaaaactctgagaacaattagactaatgaaattaaaatgagtttgttagggaaatttgttttttctatgggacttttttttcttttatgtctttcaaaaagtggttattttttaacataaaatgttaagtgttttcaatatatttatcaaataaatatgatcagctcttgcattccacatctgtggattcaaccaactgtagataaaagtgtttttaaaaaattaggtctttactgaacatgtgcaaacctttttcccattattctctaaacaatacagtataaaactatgtaatagcagttacattgtattaggtatcataggttcacaaatctagagatgatttaaagtatacagcaggatatgtatagtttatgtgcaagtactatgccattttatatcagagacttgagtctctgcagatttggatacctgcaggaggtcctagaaccaatcccccatggatacagggacccctgtatatgtaatttcctgagtgttatcctcttcacagcgatcactttgagaggttccaggctttttaatgatgctaagaacattatcctgtctctgtctcccgcatctgtctgtccatttgtctttatgatcatccatctttgcattcattcaatgaaacataagagactgtaggaatattccagtcatgatgctaccgttagaattccttttcatgcattgattcaacttaatttgagcacctatggtctactctacacaagggaaagacttcagagccccccttactttcatttgaacctcattcacaggggcttgctttattccttcagattggattttattttaaataaccaaaaagtttccagatataagttcattattctaattaagatagttccatttattttcagttagaaataagatacaactagccaggcacaatggctcatgcctgtgatcccaacactttaagaggccaaggagggaggattgcttgagcctaggagttcaagaccagcctgggcaacatagcaagacctcatttctattttttaaaaaagaaataggtataaccaataaaagttgttttcttgcagattataacaagacctctatattattttctgctcataatcagctaccactttgaaggattcacccacgttttttgatggcttcagcacctggcttgcagggatttttttccctttggtggtcagcctgaccttatgatacctttacttctttagtgctagcactttacatccctttctgctttgttgtatcccctttcttaacaccatcccattttacctcattgtagacaatacttattttgaattctcattaccccatgactttcagagtcttgacccctttttctagtccagtagtatcaattcaattttgtagccaaccatgccctcaaggtcttctgttttgaatgctgctttgtttctgtcctaaaatcctttatatcttcaggcatgcttagtcttgctatctttgcatcttttatcctttttgatgtatccctatgctcagttctagactaccacaccatgcttgattcaatcagctctgaattcatgatctttaatttggtcctgcccttttaaaaataccgctttgtttttgtttcgttttgttttgttttgagatggagtcttgctctgtcacccaggctggagtgcagtggcatgatctcggctcactgcaagctccgcctcccgggttcatgccattctgctgcctcagcctccccagcagctgggactacaggcacacgccaccacgcccggctaatttttatttttatttttattttttttgtatctgtagtagagacggggtttcaccatgttagccaggatggtctcgatctcctgacctcatgatccgcccgcctcggcctcccaaagttctgggattacaggcgtgagccaccacgcccggccaaaaataccactttgtttttatctacaacatctgtcagattttattctagtccctcagttgttaaccttgcctaataattactcagaggtcatacttttcgtttttctcaagattaactttttcctgtctcaaggttttttttccttcagacattaatctcaaaaaacagacatgtcccactttttttaagttaaccctgttcgtcatctcttgcatttcctccacacccttatttcattattttggaccttcagttcatctctttctctctaccacattcattgtgtctgtagatattttcaggcttgtttttaggatgaggaagatctgcctttactttgcatgctttcttgttcctccatttaccatcaacatttataaagagtattctttactagcctgtttgtcattttttgactctttgtgatttgagtgtcacccccccaccccccaacgccacctacatacagctaaagcttctcctttaaaggttatcagtcatatcctaactactggatgtactcattatttttcattcttactcctctatgacttcttcagagtatttgacatttttgatcacttacttttggaactcttctcaacttctgtctgttaaactgttaccaccatttttcttctttccttttggctgctactcctctatgtaattatcttttctcccttcaactgttcttgtccccttataatccctttcttggtaccttaaccattcttaaagttttatcttttacctttcaactgtaaatcctctagatttcaaagccgagtttccctgagacccaactgtttgtttctaactaggattcaaaccacttttacttcaataccctttaagctcagtctgtttcagggcatcatttgcataaacatgaagcaccagctagaaataatttactatcccaagtttctgaagcccatggagttctcttgatctgccactatacatcctagcttccggagagtccaccttttgcagtttaccagtctgcctcttccactactacagtggttctgcacctataccccagtttctctaaagcagaccctagccaacccttcccccagtacactgctgtgattaatattgttctcttattctgtgctaaacacttggctgccctagtgaggctttaattctgccactaatttatagaggattaaattggaaaatatttttggcattacttaaacccatgtgtcattccgtcctcccctctcccattttccataggctcaccaactgtcttgtagaaccttcagccccattctatccccagacattcccaattgacctaaagttaccttcataacattttcctaatttctggtgagcccctgcactgtcatcacacacattgagctcttactcatcattaacctcatctagaactgaaagcttccacttctactcttctgagggcctcgtaggtccctttgcttttcccctacttcaagggtacactgtttccctcattgcttcaggtaccttcctctgaatggtgcaccctcactcctactcggtgtggacttttgtcataggtttgagttctgtatgttcagaggcttcattttctcagaggttgagtacctttattcccaggctatgccaactcttatgagaagacaggccctcaaaattgatctatcttccccaatgtataggctcttcatattcagtatctaaagtagtttttcttattcttgattattctctgaaatgcccctctccttcctctcgtttcaccctctgtgaagtatctgatcagcacagccagtcacaagaatcattcctttctttgagttccgtaacattctgctcttctgcctcacatgtgtctctattacctctttgagaaagaagctctttcgttgtattcaccatggtgcctattctgaggatgttttcttggaattacagctagccagaatctttattttcccatgcatatatagtaagctggtgatggttaccttgtgtctgagggtaactgttgacctgctgtgttgggtctgtcagtgcaagatagggctagtgcttctcaaactagcttgcataagaatcagctggaaaacttgggaaaacagatttctgggccccactgccagagattagttcactatgtttgcagtaaggcctgaaactttgtgtttctaacaagcttctaggtgatgctgatgatgctggtccatggaccacactttgagtaatactgtgctaggctaatcctggctaatcttgcctggttgtctaacacaggaaggctttccttatcattttaaagggaggcataaaagctattaccattggctgtgaagcttgattagtggttttctgatctgtgtgtaggagaagcattgttttaattcatgagctctgctccttaatttgctctctttgaaagttctcctggtaattgcaaaggactctttaaatgtttcatgtttattgaattaagcaatggcctttatctcaagtagtgtttacttccaggatcattcagattatccccctccccaaacatattaagattaaaatgtaataagtaattattattttccagcctgggtgacagagcaagactgtctgaaacaaaaaataataattattataacaatttctatcatagcaaaatacattatcaaatatcctttaaattgttctcttaatagttaaaaaactttaatttgacactgcatttttaactcaagcattgtttttagtaatggtgaggtactgatcatctaagaaaattctcagggaaatatgtcattagaaaatataaaggtaaagtggaatgtaagttaaaattcttgaattaaacagagatgactgtcttcgtccattcaggctgctataacaaaataccatagactgggtagcttataaacaacagaaatttatttctcacagttctggaggctggaaagtccacgatcaaggtgccggcagattcggtgtctgggtgagggcccattcctcatagacagcaccttctcactgcgtcctcacatggtggaaggggcacactggctctctaggatctcttttataagtgcactaatctcataagggctctgccctcatgacctaatcacctcccaaaggccccacctcttaatgccatcactttgggggttaagattttaacatgaattttggggtgacacagaaattcagattatagctttaaccaacagaattttattatttagatcatgatcttttattcaaaactaagaaattaagcattggcttgaaatgtggtcagaaaattaatatggtgttgtataataaaattaataaaatcttgtttgtctcgtgtttctccagctctcatagcaaccatccaggtaaacggttttgtattttcaagaagcattcaggaactctcaggtaatcattgatcttttttttttctttcaattgaaatattgcagtaactttttaaaacttgatgttggagtgcctgctttggaaatgatagagttctgtttattatgtccttggaccaaagttggagggatagcctatcatctctgactaaactctgtagtgccaagcattaagatgaaaccttcatgtatttgcgtttgtaaaataacaaaaataaggttctccaaccatatctgaatagaagtaagtttatgaaaataccataatacttgaaatcaatatatagccttcataattgttaatgtttttagaattaaagtatataagttgtttactgtacagaaaaaaaattgatgaatatttctaaaggcattgataattaccattggttacaccacacacatttagctcagaatcaactaaacatctgtttttttacattattttgttatcttttgactccatcttcctttgttaattattttgctcatgttgacagatgtttgccaggcacatagtacctggcacatagtaggcacttggtaaatatttgttgaataagttaatgtatatgttgaaaatgaattatgtggataatgttggaccaacagctcatagaggaaatttttattgtatttttaaaacatactcatgttaggccaagtgcagtggttcacacctgtaatcctagcactttgggaggctgaggcgggtggatcacctgaggtcaggagttcgagatcagcctggccaacatggcgaaaccctgtctctactaaaaataccaaaattagccgggcatggtggcaggcacctgtaatcccagctacttgggaggctgaggcaggagaatcgcttgaacccggagggcagaggttgcagtgagccgagattgcaccacttaactccagcctgtgcaaaagagcaaaactccatctaaaaaaaaaaaaaaaaattatgctatttttaaagcattgaattcgaggaattagaaaagagtaaaatatattaggtgttacctttactgaaaaatgcttataagaatgaaaagagatttaattctaaagatgagacttcgatttgatttttaccacattatggtcaagctcaattgtatgcttggtttttaaattaactgtatgatttgaaagatctgaggtgcttttttttcaacttgagtggatctcacatctgaatagaaaattgatcaaattctgtgtatgggtcgggtgcagtggctcacacctgtaatcccagcactttgggaggccaaggcgggtggatcacttgaggccaggagttcaggaccagcctggccaacatggtgaaaccccgtctctactaaaaatacaaaaattcgccgggcgtggtggcgcatgcctgtcatcccagctactcaggaggctgaggcacgagaattgcttgaacctggaaggcggaggttgcagtgagccaagattgcgccactataccccagcatgggccacagtgagactcggtctcaaaaaatttttttaaaaaaatctgtgtatggacatagcattttgtatttctataaacaattttttcataattactattttgttaaaatgaaatattctttagctatttattgtgtacctatcatgtataatacagcgtaggaagtcctatacagatgaccgtgatgaagaaggcttgtaccaaccttcaaggaatgtacaatttattaaaggggtatggatataaggtgtgaacataaataactacagtaattcaaagaggtttctagtaagtgcagtgagagatacagatttcaaaggggagaaaggtttctacttacaagaagaggcacaagggcattctagttggaagaaataacatgaataaaagttcagaaaggaaaatgcagaaactatacacattctccggaatgacaatgaataactaggagtaaaatttggatgaagcacaaagttcatatagcatagtattatattaagatcaaagttggccgggcacggtgactcatgcctgtaatcccagcactttgggcagctgaggtgggtggatcacctgaggtcaggagtttaagaccaacctggccaacatggcaaaaccccatctctactaaaaatgcaaaaaaaattagccgggcatggtggtgtgcgcctgtaatcgcagctactcagaggctgaggcaagagaatcacttgaacccgggaggtggaggttacagtgagccgagatcgcgccactgcactccagcctgggtgacagagtgggactccattccaaaaataaaaaaagatcagtctggggagatagttttgaacttagatgcagattgttgaatccttgaaaacaaggctggggagtttgggcttaattttcatttggaagacattggggaagccattgatgttttgagtagaatcaagggtgctgaaggaagatcactttggaggagtatacaggatgagttgtagctgcatgagacacataggctggttaaggctattgtagtggttaagacttacttaataatgccctgggctgaggtggtggggtggtatcacatcatatttaagagcatgggcttcagaatcaaagggctccatttccaacctgatcctggcctcagtagattactgaaactaattctgtcctctgtaaaaaggtaataattgtagcacctatctctttgggttgccataagatttagatcaggcaataatgtctaaaaccctcagactggcatagagtaagtactcgataaatcgttaacatcataaaacgtttgaaatattgaatgttttacgtaagaagaaagtcagagataactacaaatttgagcctcagtattagggaaatggcatcataaaagagactttccccctaaatttcatggggaaagcacatgattccagttttatgaagataatttttgatgtgcaggagttctggctaggtgtaaatccacaacaggttgttaaaactagagaagtagccaggcacggtggcttacgcctataatcccagcactttgggaggccgaggcgggtggatcacgaggtcaggagattgagaccatcctggctaacacagtgaaaccctgtctactaaaaaatacaaaaaaattagccaggcgtggtggcaggcgcctgtagtcccagctacttggaaggctgaggcaggagaatggcatgaacccgggaggcggagcttgcagtgagccaagattgtgccactgcactccagcctggacaacagagccagactccgtctcaaaaaaaaaaaaaaaaaaaaaaactaaagaagtcaatccaaggtatgcactggtttcctatagaggtgaaatatttaagtttaaagtatctgatgaacttcaaaagtatatgtatgctttgttaataaactgataattacaggattttaaaaccttcacatttcttttctaattttatcctcatttgactaagatactagattgcagaatccacacactgtaccttttttgtttactgttatatctacaatacctagtagtacagtgtgggtgaagaaggttgtcagcaaatgaatatttatatatttcagtgaatgaatattatatccttgctttgtaagtaataacttgcacacattacttaagttgttaagggagacttggctttgagtctcttgatgcctagctttcagcaacaagttgagaggtgacaatttataaagcactaaatgttagcgtaatttgaatatggcgatgccattttcttttccttttttttttttttttttaacatagtctcgcagctggagtgcagtggcacaatcttggctcactgcaacctccgcctcctgggttcaagcaattctcctgtctcagcctcccaagtagctgagagtagctggggctacagactcacgccatgatgcctgactaatttttgtatttttagtagagacgaggtttcaccatattggtcaggctggtctcgaactcctgaccccaggtgatccatccacctctgcctcccaaagtgctgggattacaggcatgagccaccgtgcctggccagcgatgccattttctagagaactattttaaatatatcaagtttatataacaaaattggaaaatgacggttgtggagactaaaatgcaaatcaagttagtacatggaaaagtaattattgagctcatatggattttcataaatgataagaatatttcttactgtcttcttttttttcataggggcattactctagtgtgccttaaatgtgatttcctagctgattcttccggcttagatcgtatggctaaacacttaagtcaacgtaaaactcatacttgccaagttataatagagaatggtacgtatatataattgtgtttctttgattttctgatatttatttcagtacttttgatcggacaccatatggacccatgtattaaattgatagtctcactcttcatatatgctattgtaaatgtaaaactcttttgatttcagtttccaaaagtacctcaacttctgaacccactactgggtaagtttaattttccttcagtgcattttgctttgatggactttagcactgttgtattttttaatgaatcattaatattaatataaatgaaaaatattaaagtttttttttttttttcttaaagctgctcattgaaatagattcctgctccatggagttcatgcaacctggtgcaagacaagttggaagttcctaagttcaaagttctgaagtattttctcacacaaagggcagttaaacagccaagtttatgacactagctctcattattcagctcttttcagctttcagatgccactacattgttattccaccttatctttgcgtcaggttaacatatcttaacatatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagaaaatttctacaattacagttcccaaagacacagttgttcatgttatttaaagttttatccagtattctaggaattttcagcaatactaatattctcatttttaaacattttttacattttattttgttttattttggtagcttggttttatattgtttttagatcagtgcttcaacatccaggctgacgtttagccattttggctgctgttctttaatcttcctctagcaggcatgcagtccaaggaatatcaaaattctggttgtattgggaaccaaggttactttcttgtttttggaaaaacaaaatttctacaattacagttcccaaagtcagttattcatgttttcatttaaagttttatccaatattctaggaattttcagcaatactgatattcactttattttttttctttttttaagacagagtcttgctctgtcacccaggctggagtgcagtggcgcgatcttggctcactgcaagctccgcctcctgggttcacgccattctcctgcctcagtctcccaagtacctgggatgacaggcgcctgccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccactgcacccgaccgatactcacatttttaaactttttttttaattttattttggtagctaggttttatattgttcttaaatttattttactctattttatttttccatcacttctttgtcccagattcatgaaatttgctgatgtccattttatgtctacttttgaactcttctctttgtgtttgttttgttcttattacaaactccaagacatttcttagaattgtctacagatttcgtgtagctacttattggtagcttcttaatttcatacttgtccagaccattagacattattacatgctctgtcttgggcctatcattaacattagcttagggattctgatttcaaagacataaagaattggcaaaactcttcttacagaacttaaaacaagttttaaagttacatttctatacatctaatacataataccttcttagccattaatgtaattcctctggataaagataatatattcaaaaaatattgggaccaaaaaatgcacttgtttcttgctcatatatatatagatgtatattttttttaatttcttgtttgtttattttggttacattgaatacagatttgctgaacagttttgatgttatttttttaataaaatttgtattgttaaagtgccttggaaatttctaataaataacttcatataaaagc

SEQ ID NO: 5873 - DNA, 66188 bp, human
ggttccgcgctggaagtctccgggggagtcgctgttgctgaggctgtcgcctgaggtttttcgcgctcctccctttcctcctcctctttctcctcctccttatccgaaccccagtcagaccgatctgctctgctctcggtaagcggcccccgcccccgcctgtgccgcgcggaaggaggcagcagctctcccgcgcggccgaggcagccttccccagagggcggttctgagggcggctggctgagggtctctatgccggtgcggatcgacgggggtgcgggggaggggacaggcttggcggcgtggtagctggtgggccaccatcttgcgccgggccctgaagggggagggttttctggaggtagagcctggcggcccgcggcgggcagtggtttcgcgggccgcggcagctgcggcagccttctcacctcctgagtcctgtcggtctgtttccaacccggtttgggcttttcattctggaggcaactccctttcgtcttttgtacggttgatactgatgtttgacggagacccgcccaccctcaagtctcttcaatcaaacgaaaagagacttgaggggattccgaactttcaggcatcagagaccctgtgaccccttctttctgcgcaggttccccccacacaggaccggtcattccatgcccacaaccttgttctggccaaagggacttcccttctctgtcacagaaatcgtgctctattccgttattgtctagaggataagagccctgaggagaaacgtggagttaaatacactatattctaactaggaggtttgcaggttttacttaaagagatggaaaaaattatgctgaggtatactcctgctctagagatggagggagttcctttcaacttctctcaggttttaatgcttttttaaggagaaattcgagaggaaattgtcaagtgaaccagcttctgcaagcacgggagaccttcatccaggggattctctttgtttggaaagatttgttagttttgtggagttttttaaatctgcgaccttaaattttttttactattgttttcaggtttggactatgagttgtaatgtcttttagtgcccctaaacataaaatagaaacctagaagtagagttttaaactgcaaaagtctcctcttagtatttgtgaggtgtcctggtttgggggttactgtgcaaacttaatctccttacgcagaaacttcactgagcctacaaaggcactgatttgcttgtaaaattagggctgtgtacctttgatgtttctacagcagtacagattccattataatcgtatcttgcatttgtatatttcattggtagcaccccttttgagatgggctgtagggtgtcgttagaactgtttgaagatgaggaaacagcctcaaggacagaactttaccgaggtcatgtgcctaggaagtgatggaaccaattcttaaacctaggctttctgaccctcatccaatgttcaatttggtatattatgtctcactttttgtgagagtgaggtggtcacggagaataagcaaggaggctcacttaaaagttttaagaagtattattcaattcctttttcctttatatttttatttttaaggcttcattttttttcgactttttcatactttaatattatttctaagcatgttgaagagttgaagaatatcctattgaaaaagttcttaggttgaataactccaaatctcagctacttggttttcagtgagtttgtcttaagtagtgattcaaaaagatttgatttcctcagtaattttttttttttttttttgagacggagtctcgcaatgtcgcccgggctggagtgcagtggcgcgatctcagctcactgcaacctctgcctcccgggttcaaccgattctgctacctcagcctcctaagcagctggggttacaggcccttgccaccacgcccggctaatttttgtaattttagtagagatggggtttcactatgttggccaggctggtctggaacgcctgacctcgtgatccacccacctcggcctcccaaagtgctgggattacaggagtgagcctccatgcccagccttcctcagtaatttgaatcaaatatatacgtctagactttttttcccagtgctctgtacattcagagaaacatcactagtaatgaactgtagaaatgactcctgaaagtagagtattcgtctagactttattcatttgctgcaaagtagttttcttttaaggagttttttttttcatttttttgtttcctttttaactttttattggcaaatgataattgtgcgtatttatggggtacaatgtgatgttttgatatgtatacattattgaaagaggctaacatagccatcaccttaccaatttatcattttgttatgagaatgttagaaattattttagcaattttgaaatatacaatacattattagtattagctgtggtcaccttgtagtgcaatagataactaaaacttattcctcccatctaattaaacttcgtactcttggatcaacatcttttccccatctgtcccacccctgaactcccaagtctctggtaaccatctttctactctctgtttctatgagataaagttgtttagattccacatgtgagatcatacagcatttttccccagagaataagagaatccagctgctttttattaagataaatattaaagacatttgcaaaaatgtaaatcaatattacttttctcattaaatttgttttttaaaagttattctcattaaaagtatttttattaacttgtaatgggcttataaatattttaaataaaaacatttgaaatctgtctcagtttcaatttctaatatgggaaatatcaacacatattgtccatataaacataaagctcattggggttctcattaagttttaagtgaaaagaaatcctgggataaaagagtttgagaactactgatgtgatgcagtttatttatgatatgattttaattgagctcttcatgtgaactagatttgttttctttaagtgcttgtattcatcaacttaacggtatgacttcaggtaaggaaggagaagttgagaaaaatagtgcaaagtactgttgaggaatatttcacttgctttatttaatgttcacagtagtgctgcaaggaaggtattactgttttcgttttacagatagaaaaactaaggcttacagaggttgattatacttacagatttggcagccaggaagtggtagaccagaaattcccactcaggttgtcagcccctatgtccagtgttcccatcaatgcacttacttacattttccctggtggataagttttactcgtataaaaagcaaattgattaataatacatacttcttgaggttactttaggaattagtgattatagaatatcttatgaaacttacataaaatatttactatacagattggcttcaaaaggccagtaattgtacattagtcttttccccatattatatcttttacatatgaattataataaaagcgtatgcctataaagtctataccctgagtataaagtaaaacttctttgtagaagtatattttattatagtgccccatcccaaagctgacataaaatgttttaaaatataggcaaactttgcaaagtattatgctagtgagttttaaatcttagtgtaaaccagctattttctacaaatagatgaagtatgaaaattaacagagacaaaagttgaaaatgaataaggataaaataataaagttattaaatgtcttctcaaaatgtacctggacttcatgtgttcaggctttcagaaaaaaagataatttgcatagtataaaaacttggacaaagaaaatatgaagagcctctattttctttctgaattgtatgtaatttgttcccaaaacctactttgaaagtttgaatcgttgagatgccagtcaaattgtctaaggaaccaagatataatccagttttcttggatttgcgtactataccaattcttgttataagaaaaacatttcacagacacccctgaacttaaaatgtttgaaacattctcagagttcttacacaaccataaaacaaagcagtcaagtgaaactacaaaaccattgccatttgaatcagctttcatatattgaatgagtattttgctgagtcactgcctacctacttctattgagtttttcatacctactgatatatactatatatataatatattccctacttatatataaataatagcaaggttttttatttgaaccctttcagtaccttcatttctatagctaaccatatggtcattgcccttcatttagtgcaaatgcgtcatttatgtatataaggttggtcacccagagaatccccagagcaggcttatgttaatttttttagatagcaaaagttaaatagcaaaacaaaaagagaattatattgttatagagctctcttgcacaacctggaatatatctattttcctgagaggtctgttgaccctggtttgaaaaatggggtaatccattgatgaatttattagtagttttaaacacagttgccagaaacctagctcaaagtagattaaaccaaaaatgaataattattttctctcttaactgaaaagctgttgtggataatttgcttcaggcatggttagcttcaggtatttaaatggtatcatcaggaccggtcgaatgtttacctactctccctttctctactccagaatcgtacagctttgctatctttgttaggttctttctttggtactttttctccacatcactcccaagcttaaatcctaccagctgattattttttctttctttctttctttctttctttcttttctttttttttttttttttgagatggtgtctcactctgtctcccaggctggaatgcagtggtgcaatctcggctcactgcagcctccacctcccaggttcaagctattctcctgcctcagcctcctgagtagctgagattacaggcacatgctaccacgcccagctaatttttatatttttagtagagacggggtttcaccatgttggtcaggctggtctcgaactcctgactttgcaatgcacctgcctctgcctcccaaagtgctgggattacaggcataagccaccgcacctggccttattattttcttaatggcattattgagatacaattcatatagcatacaatttactcatttgaagtgtgcaattcagtggttttagtatattcacagttgtgcagctagcaccacagttaattttagaacattttcatcaccccagtaagaaaccctgtacccattaacagtcactccccatttcccaccaaccctcccaaccatatgcagcctctactctactttctgtctatggatttgacatttctagacatttggtatgaatgaaatcatacaatatgtggtctttttgactgtcttccttcacttagtataatgttctcaaggcccattagtattgtaacatgtatcagtgcttcattcctttttattaccaaatagtgttcagttgtatggatatatcacattttgtttgtccattcctgagttgatgggtatttgagttgtttccactttttggctattgtgaataatgccactgtgaacatttgtgtgcaaatttttgtgtggacatatgttttcaattgtctgtctctaggagtgtaattgctaggtcatgtgataactctgtttaactttgtgaggaactgccaaagtgttttccacagtggctgtaccatttcacattcccaccagcagtgtatgagggttccaatttctctacatccttgccaacacttgtgattatctgtcttttaattctagccatcctagtgggtgtaaagtgacatccattaactatttaaatgtttttttattgtggcaaaatacatatactatttaccattttaactatgtcaatctatttttaactttttgtagaataaactcttgtaaaacatagttgaattttagatacataaaagctgaaaccaaaaaataaataggaattataattatttatacaggcagtcttcaaaaaaatgaatgggttgtgttcagtaggtgtttcctcagtcagttactcagaattcattttttttccctcagaagaacagtgtattaaacatgggtatagtgtctccacctgaatcggtagctgaaatatggggtgttctttcctcttgtgcctattttgatgccaactctgagttgcagaacctagagaccctctggagttgctattataggagctcttaagatgcccactgcatatctttgctggatattccatttctctgacagctgacttaatcccccatacaattccttcccttgccaccaaaattctgatgtggtgactttaggggtttttgtgatagttttagaaggctgcaatccttccccaaaggaatccatgaagttgtatgtatttgtttattttaaaaactggaactaagtatggtagtattcttttgacgtgtcgtcccatagaaattccatagctgcatcatccactatagtagtcgctaaccacttgtagcttttgagcacttgaaatatggctagagtgactgaggagctggatttttattttttaattaagttgaagtagccacatgtggctagtggttacctcattggatagcacagctttggactgaagttatggctctaatggcatctaaagatttctgactttttagagcatttatgagcgtaccaattgagactctttggtggctgcattgggcctcaaaagctatctctatagccataggcagtaaatatgacttgtttatatagactacttgtacatttagtaatcattttaggatggttatgccaataaatattttatatgatcatttaattaaagtgttaagccaggcacagtgatgttcacctgtagtcccagttacttgggaggatcacttgagcccaagagttcaaggctgtggtatgcgatgatgagtcgtgcttgtgaatagccacggcactccagcctgggcaacatagtgagaccttgtctctaaaacataaaaattaaaaaaaaaaagtgttatatgaatctcataggctgtgcaattgtgactttaaaaaattctgtgctcttggtagcaatagatccttaatgttgagcaagaatggtcatgtatttatctgcgtggcatatgtattaccttaattctaatttaggaacaagcactaactatccaagtagttgagtttaaagagatttgaatagtcagacctcaaaactagggacatttactgaattacagaattcactagagactcttgtagtagaaatccaaacatttatacaagtaacttcttttggagttaaagtaatattttcccctttgctctaattccgtccaaataatttggaattagggagtttgcttttgccagttggaagataaagacaaatgtggagactgaattagctctgtatatcctactttagatttctgatgtctgatttttaccttttttgttttataacttaaatagtattttaaaagtttattctgtatgtagaatatatggtatgttcagtgcacgagaactcaggatacaaattcctgttttagaaagcaattcacattttttttgataacgtttaatgtaacagctttttgaaaagcccaaagaaccgtagacggattgtaaacttctgaaggcaaggactatggcttattcatctttgtattttccctagaacttggcatactaccctgagcacaaaaggcaatgaacagttactttataatgaattgttttactacgcaatttatccaattacttttctgttacttttcaaaaaactaaaaatatctaaatgtatgtgttttcttatagtaataatatttctgaaatgtgaagaataggaatcagttaaagattaatgtcacttagcatttcagaattcagatttactaaaacatatattacaggataattactcatttttgcataaagatcccttttgaagtttatttgtaatctgataactccgattttttcaagtagtaaatgtttaatacatttaactatatgttaaatgtattcatttggaaatgaaccaattatggaaaatgaattacctgtgtgtattaaacatatcaaactcaaaaggtgggcttttgtaggagaaaaagactaaatttatgtgcatttaatttaacaaaatccacactagtagtagacatctttattttagagggtggaaaactgagacctagcttactgtcttgtctggagtcatatggtgagtgtgctggagatcaaaattagacccaaagattttggatctcaggtttcatgtttcaatacttggtgttacttaaagtgactcataacattgattgatgtcatgtgttcgtacttaggtgaccttgcaacttcatggatgacgacaaaccttttcaaccaaaaagtaagtatttctgctgtagttgatactaataggcatggtttttgtactgtaaacctttcaaaagaaaagattagagacagaagtgggcacattttcttaaaaacaaatattatttatttatttatttttatttttttgagacagagtctcactgtgtcgcccaggctggagtgcagtggcatgatctcagctcactgcaagctccacctcctgggttcacgccattctcctgcctcagcctcctgagtagctgggattacaggcgcccaccaccacacccagctaattttttgtattttcagtagagacggggttttactgtgttagccaggatggtctcaatctcctgacttcgtgatccacccgcctcagcctcccaaagtgctgggattacaggcgtgagccaccgcacctggcctgtttatttttaagacagattctcactctgtcacctaagctggagtgcagtggcgtgatctcggctcacagcaagctccgctgcccaggttcaagcaattctcatgcctcagcctcccaagtagcttggattacaggcacccgccaccatgcctggctaatttttgtatttttagtagagatggggtttcaccatgttggccagagtggtctcgaactgacctcaagtgatccacccacatcggcctcccaaagtgctgggattacaggcgtgagccactgtgcctggccaaaacaaatatttattaaagtaatacatattcctagtttaaaaaaaaatacagtaaacatgtcagtaatagatatgaaatgtttccttctcatccccagcgataactactgttgtaggtttagtatacataatcacaaacttttttctgtgcatagacaaaaaataatttctaaataagatcatactatatatgttattatgtgccttttaaaattttttgctcggtagcatatcttgaaattaacaatgacagtactcagtttaaaagaatggggaagacctatttatttgttcccataatatcacagtggtgtcaacatgaatgtaaattactttttcaatcatcagtatatatgagtctcccttgtttctttaaatctggcattgcctggctttacctagtttcttaccccatagataatcatgtgttaagtacctactacatatccaatacactactgtgtgtaggaggaaatacaaagaaagaaaatatgtttttcactctcaaggagcttactttggagttgaacatgtataattaaggcacactaagaaataggcagtttgagatcatatatattaaatcttgaattgcatagcatagactgtcagtgcagtaagaggttaaagaaaaacaaatctaatggtttgctgaggaagttataattgaactaagagttggaaaggggcaaagaatcaatttggggggatatctgtttgaagttagatacttattaatatggcattttcctgaatctctgttaccacttctattaggtagatattgtgctcatgttagaggtgagaaaatagattcaagtaatttctccagagtcacataattaaaaatggtgcagtgaggatttgaactattcaatttgatgtcaagtgcatgctctttccactatactcgaatgatgtggacagtataaggtaaggagaaagggtattccaggtggaagaagcagtacgaatgaggacttcaaaggacacaatgagtgcggtattttcaagtattcagaatatacaaatactgaaatatgaattaatacttttaattgtctgacttacaacattctatgtaatgttttttgaggtatttggaaaaaagggtcagttcataatattggttacatttgggagaatttgaagattttttgttttgggggtttctttgtttggtaggcagactactgaacatcaaacaatgttatgccaagccatgatatctggcatatctgtatagaagaggaaatcaaaatgttttaaaagaatggaaccaatttgttaagaggttttgtttgtgtactgtcctcaaatcattgttttcaagttttacatgttaaggccatgctaaaggatggccttaattttgagtcaaaagtagaaatggcattattttaatatagtaaaattactgttaggaatgactgcatttgaaaaacaaagatatcattgtctaagccagaaccctgaagaagttttattttgtttttatttattcttatagttgtccccgacaatccacatgtcactccaccacttatatacattcccatttttattatttattatttattttttatttttttgagacagagtctagcactgtggcccagactggagagcagtggtgccatctctgctcactgcaacctctgccactcaggatcaagtgattctcctgcctcagcatcccaagtagctgggattgcaggtgtgccccaccactcccagctaatttttgtaatttttgtaattttagtagagacgagatttcaccatgttggccaggctggtctcgaactcctggcctcatctcagtctaccaaagtgctgggattaaaggcgtgagccactgtgcccagaccccattgctgttacattagtttacatctccttcactattttttaacctaaacaatacacttatctttttttaaagtcaaacaacttgaaaagcctttaagttacttaagcacagtctcttgaagggagggagtgaaggagagagagagaggtagagataggtgtgtatgtgtgagcacatgcaggtacctatatactccctgttttttcaagctaaaaaactgaaagcatgtactttcagttgtatagctgtttttctaataattccacgtttctcaatttttaaaactcatatgtacatatgttgtctcttgaatcatcaagttttgccattacctagtgattttctgtcaaggaagatgaggattttggttttcttaaagctttttcttccttttaagcatctctcaatatagttatatctgaatttttcagtaaatcatattcagtgattttatgatgaccgtaatactgttcacgggtgagcatggtactgtattaatgtattatgatggatacatttccttttctctttttctatgtattgtccaattaaaattttcattttataagtcagcaaagtttattaaaacctatagccactcacacccttccagagcctttttttttttttttttttttgagacagagtctcgctcttgcccaggctggagtgcagtggcgtgatctcggctcactgcaagctctgcctcccaggatcataccattctcctgcctcagcctcccgagtagctgggactacaggcacctgctaccatgcctggctaatttttttgtgtttttagtagagacggggtttcaccatgttagccaggatggtctcgatctcctgaccccgtgatctgcctgcctcggcctccgaaagtgctgggattacaggtgtgagccaccgcgcctggccctctttcttttattttattttctgagacagtctcacgctgttaaccaggctggagtgcagtggcgtgatctcaactcactgcacctttacctcccgggttccagcaattctcctgcctcagcctcccgcctagctgggattaaaggtgtgcgccaccatgcactgcaaatttttgtatttttgttttcagtagagacaggattttgccgtatggaccacactggtctcacactcctgacctcaagtgatctgcccacctcagcctcccaaagtgctgggattaaggtcgtgagctaccgcgcccccccacttctttgtcccctttttttcttgagatggagtctcccagtcgcccagactggagtgcagtggcgcagtcttggctcactgcacttcccactcccgggttccagcgattctcatgcctctgcctctgcctcccgtgtagctgggaatacaggcgtgcaccaccaccgcgcccggccccatggcctcttaattcacttttcctgcactgaaacttgtcaggtaatctaacaatttaatgtttaatattttaataatatttagggggattggcaccttcctgggagtggtattctcctgcacagctcttgtcctgggactttcttttgtttttgtattgtgctcaatgtcagattttctgcatcctgtgccattctccttcttaagtcttgttttggtggattcctactaagaaagggggaatgagagggaaatgttgtataatattgctggtctttattcttattcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagctaatctttgtatttttagtagggacagcgtctcaccatgttgtccatgctggtctcgaactcctggcctcaagtgatccacctgccttggcctccgaaagtgctgggattacaggcctgggccaccacactcagccacctggcaatttctgatattctgaaatttcatatgtcccgctagtgtagtttttattcttgatcattgtgctggctgttagtgggccctttctttctgtagatttatatccatgagaactaggaattttttttgtattttcctttgattacttctcctctcctttttctctctcttttttttttttctggagcttttgttaggtgcattttatacctttgaaaatgatttttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgacagagcgagactccgtctcaaaaaaaaaaaaaaaaagaaaaaaaaagaaaatgatttttctaccaatcttgttttctgtgtttaatatatgtgttttttgtcttttggtttcacatttactcaactttgacatttgacttttttttttttttaactgaattttggctgtctttatataatatcgttgtcttatctgtctaaagatgtttattatatcctattattgtctcttgctctgtattatctgtgtcttctttttttaacttttattttaagttcagggatacatgtgcaggtttgttatgggtacactcatgtcttgggggtttgttgtataggttatttcatcactcaggtattaagcctagtactcatgagttatttttcctgatcctctccctcctcccaccctccaccctcaagtaggccctcagcatctgttgttcacctctatatgtccatgtgttctcatcatttagctcccacttataagtgataacatgtggtattaggttttctgttcctgcattagtttgctaaggataatggtctccagctccatccatgttcctgcaaaggacatgaccttgctcttttttatggctgcaaagttctccatggtgtatatgtaccacattttcttcatccagtctaccattgatgggcatttgggtcgattccatgtctttgctcctgtgaatagtgctgcagtgaacatatgtatacatgtgtctttatgatagaagagtttacattcctttgggtatatacctagtaatagaattgctgggtctaatggtagttctgtttttagctctttgaggaatcaccacactgtcttccacagtggttgaactaatttacactcccaccaacagtgtataaatgttcctttttctctgcaacctccccagcatctgttatttttttgacttttgaatagccattctgacaggtgagagattatatctcagtgtggttttgatttgcatttctctaatgatcagtgatgttgtgctttttttcatatgcttgttgcctgcatgtatgtcttcttctgataagcatctgttcacatccactgccaacttttcaatggggttgtttgcttttttcttgtaaatttgtttaagttctttatatatgctggatattagccctttgtcagatgcatgatttgcaaaatttttctcctgtctgtaggttgtctgtttactctgtctctagtttcttttgctctgtctatagtttcatttaattagagcccatttgtcaattttggctcttgttgtaattgcctttgacgtctttgtcatgaagtctttggccattcctatgtccagaatggtattggctaggttgtcttccagggtttttatagttttgggttttacattgaagtctttgatccatcttgagttgatttttgtgtatggtgtaaggaaggggtccagtttcagtctcttgcatatggctagccagttatcctggcaccatttattgaatagggagtcctttccccattgtgtgtttttgtcagctttgtcgaacgtcagatggctgtaggtgtgtggccttatttctgggctctctattctgttccattggtttatatatgtgtttttgtaccaggaccatgttgttttggttattgtagccctgtaccatttgaaggcaggtagcatgatgccttcatctttgttctttgtgcttaggtttgtcttggctatccaggccttttttggttccatatgaatttgaaaatagctttttcttgttctgtgaagaatgtcattggtagtttgataggcatatcattgaatttataaattgctttgggcagtatgccattttaacaatactgattcatccaattcatgagcgtagaatgtttttccatgtgtttgtgtcatctctgatttctttcagcagtgttttgtaattcacattgaagagatctttaacctccctggttagctctattcctaggtattttattctttttgtagctgttgtgaataagattgtgttcctgatttggcacttggcttgactgttgttggtgtataggaatgccggtgatttttgtacgttgatttgtatcctgagactttgctgaagttgtttatcagcttaaggcacttttgggcagagactatggggttttctagatattggctcatgctgtctgcaaacagggatagtttgacttcctgtcttcctatgtggatgccgtctatttctttctcttgcctgattgctctagtcaagacttccaatactgtgttgaataggaacggtgagagagagcatccttgtcttgtgctggttttccaggggaatgcttccagcttgtgcccattctgtatgatgttgcctgtgggtttgtcatagatggcccttattattttgaggtatgttcctttaatacctagtttattgagaatttttttttttttgagacggagtctcactctgtcaccaggctggagtgcagtggcacgatcttggctcactgcaacctccgcctcctgggttcaagccattctcctgcctcagcctcccaagtagctgggactgcagacacgcgccaccacacccagttaatttttttatttttagtagagacagggtttcaccatattggccaggatggtcttgatctcttgacctcgtgatccgcccacctcggcctcccagaatgctgggattacaggcctgagccaccacacctgaccgtttattgagtatttttaacacgaaggggtgttgaattttattgatagcctttactgcgtgtattgagataatcagatagtttttgtccttagttctgtttatgtgatgaatcacatttattgatttgcatgtgttgaacgaaccctgcatcccagggataaagcctgcaggatagtagtagataagctttttgatgtgctgctgtattcggtttgccaatattttgttgaggatttttgcatccatgttcatcaaagatgttggcatgaaagctttttggttttttgatttttggttttttcgttttttgtttttcattttttctgagatagcgtctcattctgccacccaggctgtagtgcagtggcacgatctcagctcactgcaacctccacctcctgggttcaagcgattcccctgccccagcctcccaaatagttgggcttacaggtgtgcgccatcatgcctgggtaatttttgtgtttttagtagagacggggtttcgccatgttggccaggctggtcttaaactcttgacatcaagtgatccgcccaccccggcctcccagagtgctgggattaaggtcgtgagcctctacgcctggctccttctgtcacctctgtttttgtttttgtttttttttttttttcagacgaagtctggcgctgcctcccaggctggagtgcagtgtttcgatctcagttcactgcacttccccttccgggttccagagattctcgttctctcctgggttccagagattctcattctttagcctcctgggtagctggaactacaggcatgcaccactaccgcgcccggccccatggcctcttaattcacttttgttacactgtgaaacttgtcaggttatctaacaatttaatgcttaatactttggaagattggctggtctcctggaaatgatattctcctgcgctactctggctgtttgctctgtagacctactgcacagctgttgtcctgggattttcttttgtttttgtattgtgccgaatgtcagattttctgcatcctgcattgtcctccttcttaagtctcgttttggtggattcttcctgagaaagaaagggtgaatgagagggaaatgttgtataatattgctggtctttttttttttttttttttttttttgagacaggtccttactgcgtttgcctagactaaaatacagtggtgccatcatggctcactgcatccccagtctcctggggctcaggtgattctcccacctcagcattctgagtagctgggaaagaagtacttgccatcatgcctggctaagctgttctttattattattattattattttatttttttgagacagtcttactctgtcgcacaggctggagtacagtggtgtgatctcaccttattgcaacctctgcctcttgggttcaagtgaatcttctgcctctgactcccaagtagctggaattacaggctttcaccatcaccctggctaattttgtattttagtagagatgggggtttcaccatgttacctatccaggccggtctcgaactcctggcctcaagttaaccacccacctccgccttccaaaatgttggaattactggtgtgagccaccgcatccagcaaagttttatttttttgttgtgtctcttccaggttttgttatcaggacaatgctggcctcatagaatgagttaggaaggactttcggtaggaatagtaccagctcttctttgtacatcttgtagaattcaagtgtgaatccatctggttctcacctttttttgattggtaggctctttttactggttcaatttcagagctcgttattattctattcagggcttcagtttatttctggttcagtctggggagagtgaatgtgtcccaaaatttattcattttttctggattttctagttggtgtgcatagaggtgttcataatattgtctgatgtttatttgtatttttctgggttcagttgttgtatctcctttgttgtttcttattgtgtttatttggatcttctctcttctgtattagtctagctagtggcctattttattaattttttcaaaaaacaactccctgattcactgatcttttgaatggtttttcttgtctcaatctccttcagttcagctctgattttggacatttcttgtcttctctcttagctttggaattggtttgctcttggttctctagttctttttgttgtcatggtaggatgttaaattgagatctgtctttttgatgtgggtgtttagtggtctctttacataatcccatatttctcagaagtcttgtttgttccttttcattcttttttctctatatttttttggctatcttagaaaaccagtcttcaagttctgagattctttcctccgcttgttctattccgctattaatacttatgattgcattttgaaattcttgtatgtttttcagctctatcaggtcagttacgttcttttctatactggctattttgtctatcagctcctgtattgttttactatgattcttagcttccttggattaggtttcagtgtactcctgcatctcagtgacctttattcctgttcatatcctgaattcttttttctgtcctttcagccatctcagcccccttcggaacccttgttggagagtgaatgcagtttggaggaaagaaggcactctggctttttgagttgtcagagttcttttgctggttctttctcttctttgtgggctgatgttccttcagtctttgaagtcactgtcctttggattatttttttcttctacctgatgaccttaagggtttgattgtggtataaggtagattcagtcaactggcttcatttctagaagattttagggggccaaggctcagcttacaactcctggagtgcatgctctaattttgtaggactgatattggacctctgcttttttctctggcttctcaaggttaggaactcactgtgctagggggactgaggtgctcgtggacctcttgtcccagcacgccaatgggtgatgccagccaaactgttttgtagggcagtgacagcagggcccattcttgttcacacatgccagtggcagcagcagcacagcagagtgcacactcatcagctgctgcagggtgctagtggcttctgcgtgggctttcgcagaagtggcagaggcagcatggctcaggggtgcaggggccccaggtggcaactgtgtgtatggtcatgctggtggtggcattagcatggggatggggcactggccgttgcaggactgtatgcactctttgtacatgttgatacaggcagagatggccgctcagggtgggggagggtccactgttctctgtgcgtagttacattctagtggcagtggtggctcaggggcagggtgctggtgggcacaggtcttgcgggctctgtgctcaccaaggctccgactacaatggtagtatggcagaggagggtgggcggagtgcactcccactggcagcaggcagggcagggtgcacatacacatatgttcttacggggcagggaaggcaagatccacttgcgcacatacgcactgactggcaaagtgatgtggagggtggccatggacccagggtaagctggagtggggagaatgagcaggtgggccagtgcatggccacaggggcaaccctgctggagctctccgctggtcaagcccggttggccagctcaggagctatgatgctggccatcagggcactctaggctgtactgcaagagggaatgggcagactggggctccaggagaggacagctgaccaaagagtgctcaggtcagatgggcaagaccaccctgcagagttcaggtctgacagttcccctagtgctacagtctcctatggaaacaagcagagcctagggggatgggcatcccaggctgtgcttgaatacagatgttcctgcaacaaaccctctgggctccactctggctcgtgtgctgcctctaccacttctctaagcagctctccctgccaactaaagtgtcagtggtgatcaaagggtcttctcctgccgggattcccagaggtccatggcaagagtgagttgttccttgccagttcaactcacccattcccccgtagtcattgggggccaggaaccaatccaggtgcacagtagccccatacaggcttcccagtttcctcccgcttcattctagcttctgtgtcttccctcagcccactcagcacctcccctttgaagatgtgttaagagtgcaccagttgtcccagtccctcggtggcagctgttccacctgtctgtatctagtttgccatcctgcctggctgtcggttttctttaaaatcctttaatctgttttattgctttggtgtttcacattgaaggttttcctcaattttctggtacgcattggttgtccacccatatttaagagtgaggcactaaaatgcttcccaggagatctgatttgggtcagaacttgtaggctggtgatattcacagtatattttttacttagtttcttcaaatgagaaatgtctaatctgtcctgaaacagaattaagtttcacttaatttccctattttcagtctagtacctcatgcctgctttgccctgtgcctgatatacctgaatctggttccgtttttctagtatatctcctatgtattttctcttattcttagtttatctcccttgtttatacaagtgaatttttttttcagataatagctacagtcttttttgtagatataatcatcctagtcctataactaaaactcactttggatttgatcctaaaatgtattggccactgtaaatgactactatccttcattatctatctgtctagccaagtttaactggtttagatcttagagatttagttctgagctcatttcttttgctaccatgtactgattacaaggcagagatggccgctcagggtgggggagggtccactgtagaccatgcctgtagtcccagctattcaggaggctgaggcacgagaatcaagtcagtaggctgggcatggtggctcatgcctgtaatcccagcactttgggaggctgaagcaggcggatcacttgaggtcaggagttcgagaccagcctggtcaacatggtgaaacccatccctacgaaaaatacaaaaattaactgggcgtagcagtgggcgcctgtagtcccagctacttgggaggctgaggcaggagaatcgtttgaacccaggaggcggaggttgcagtgagccgagatcacgcctgggcaacaaaagcaaaactctgtcacaaaaacaaacaaatatcaagtcagtaattgctattaggattattacagtgcatcttaaatatcatactatgtattgcacagaaaatatttttctctttgaaaataaagttagcttctcttctcttgaaaattagacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaagtaagcatttactttcagtgaagtaacgtttcataagatggttgtttctaatggaaaatatatgagatatctgtccttcatactgttgttcttctgtaaggagttagaggtaagagggagagtaaaggtcagtaagaacttgtgagaatcaaagcgggaatgtagttggggactggagtaaggaggtgaaaggttaaaatatcagatgtgagcaaaaggaaataactaagttaattgagggttaagatgacctgaacagcattgtaagccttctgagattggaaatcataatttttaatggaaccaagtagcctatttatttgttaatttttttttctcccttaaactcagatttacagaaaaggaagtgtttggaatacttttcttaaaatatcctgatatgctaaataagtttgtgttagtgtctgatgggggttctaatgtctaagcaactgcctcatcaaagtatcatcttgatatatgactataaaatgcataggtgctgcatgattatagaatctctggtctgtctaccagcatgtgctatagcctttggctacacccatcttccgcaactactgtttatattcatgaaggagggagggcctggttttccaacactatacttggacaatgcaggcagtcagcacacgtaaatctttttggctttctagcaaaacatgtccagtacctttgtggattgttagatttctgttagagtaattagacttggcattattacaatgttaaagtgaagatactggtgatgtttattaaaataaaatatctcctccctgtaatcctagcagtttgggaggccgaagtgggtacatcacttgaggccaggagtttgagaccagcctggccaacatggtgaaaccccctctctactataaagattaaaaaattagccagtcatggtggcgcgtgcctgtagtcccagctactcaggaggctgaggcatgagaatcgcctgaacctgtaggcagaggttgcagtgagccaagatcacgtcactgcactccagtctaggcaacagagcaagactatatctcaaaaaaagaaaaaaaaaaagtcctcaaatatgtctaaagtgcaagggacaacataactgaatttcaggagagaaagagggaaacagatcctttttcattttatttacttattttaggcctggagaagtcaaggaatgtagccagcataccagtcttctttcttaccatggcaatgagtaatagtgtggttaagagatgagttttaaattttctgaaatcctagttcttacttctcttggctctaaacttggaatagcatttctactcagttttatcagaggcagaataatttagccaattgaattctcagtatcatttcctgtggcaaattgggaggttctaagtggagagccacttaaattattaaatgagctagatatatttggcatatttattattgatagtagaatagaatattctcttattatttctagtcactgtgacaatttttatgctgaaatattaccatatttcaaaattattactcaaatcatcttattgaagcatgacaagattcaagttggatttatattgattgtagatgacttagcagtactcaaccaaaacaatgtgtattcgtttcaagagattctatcaaaaagggtattgggcccactagaatttcttttctatattgataacttagaatttaagtgattttattgatgttttatttgtgagctataaaatattttagcatatgggatctcatctaaatgtttatatagaaaaacaatgaaggcaggggaaggagagcaaaaaacttgtgattggtagactataaccaccaacaagtaaaaatagctcttagtggattgagtaatacttatcttgaatttctgaatgaaaacattatcaagttgtttgaggatatttttcttttagaagacttccgtaatgtttactcatagagtactgcatttctatgatcagaaagcaaccctactttggtgtgacccttcacttaatagaattgttttgtgagatctgattcttttctctctttttttttttttttttttttttaagatggagtctcgctctgtcgcccaggctggagtgcagtggcacgatctcggctcactgcaagctccacctcccgggttcacaccattctcctgcctcagcctcccaagtagctgggactacaggtgcctgccaccacgcccagctaatttttttgtatttttagtagagacagggtttcaccatgttagccaggatggtctcgatctcctgacctcatgatctgcccgcctcggcctcccaaagtgctgggattacaggtgtgagccaccccgcctggccgggatctggttcttttctactaggagagaaaaaaggaaaatgtttgaggttttatgggatttgttaatgctttgtgccttttcctgataaacaattttaagcaaatcactattcttccaaatttcaatttgactcctcagtaacctagaagttacggagttcatatgggtacaagggtgtgcagtcttaaaccgatccagagggttttgtgaggctcaaactgacttctagcgtagtaatagatttgaaaccccttacattaatcagatactctggaactccaggtttaatttagtctaatcagatactctggaactccaggtttaatttagtctgtagtctctgataatttcctattcagaactcaagagtaatggtacagaaagttaatccagtcagccctcccatcatgaaacttccagatttttagaggtgtgaatgtggcacagggttggggaagggtttgatttcaagtcacgggaatcagaatctgtacacaaccctgtcaccattaaaggaaagaaatatacttcaattattggttatgcaaagatatgtttttggaggaatttttctattagtatatatttcattcacataacaaattttaaaataaatataattttatagatattttgaacagaggccactccagctcatcttcaaaaggaataaagagtgagccacacagtccaggtacagtattactgtagtatttcaattttaaagttaaatattttgatataattggttgtatagaaatatattcaatatgttgtataattttaaaatacaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgtaagtgtttataaaattacacaattaattcagggacacattggctattataatactgagttaaaattgtgatctgtcagccgggcacagtggctcacgcctgtaatctttggtactttgggaggccaaggcaggcagatcgcttgagcccaggagttcgagaccagcctggccaacatggcaagaccacatctctacaaaaatacaaaaaattagctgggcatagtggtgcaccacctgtagtcccagctactcgggaggctgagatgggaggattgcttgagccctggaggtcaaggctgcagtgagccaagatcataccactgcattccagcctgggtgagagggtgagatcctgattcaagaaaaaaacaaaagccaacacaaacaaacccaaaaaattgtgaactgtcatagctagttaccatttcagtagaaaaataatccccatctttatgatataactcaaccaaaacccaaaataataactgcaggaattgtccaacatattaataaatcagctaatatgcttaaatacagtattgaaaactatactatctaaatatgagtgaaaaagtatgatcaggttgggcatagtggcttacacctgtaatcctagcactttgggaggctgaaggaggtggactgcttgagctcagtagttcgagaccagcctgagcaacatggtgaaaccctgtctctatttaataaaaaaaataaaggctgggcgcaatggctcatgcctgtaatcccagcactttgggaggccgaggtgggtggatcacctgaggtcaggagttcaagaccagtctggcaaacgtggtgaaaccccgtctctactaaaaataaaaaaaaattagccaggcgtgttggcgcatgcctgtagtcccagctgtttgggagtctgaggcaggagaattgcttaaacctgggaggcagaggttgcagtgagccgagatcgcacaactgcactccaacccaggcaacagagtgagactccatctcaaaaagacaacaacaaaataaaaaactaaaatgtattgcaacatgaataatgcataatggccacatttttaagttaataaactaaaacaagtgttcttaaattggaaagagtgttctgaagtcattattgcttattctgaaatcatactttcatagtttagctttaaaaacttttaataaaagtaatagataatgataatacttaacatttactggcctgttaatatgtacaagtctttgtgctaatcttatttaattcttatggcatctttatgaggtaggcacaatttttatttttttattttatttttttttgagacggtgtcttgctctgtctcccaggtgggagtgcagtcatgtgatctcagctctctgcaacctctgcctcccaagttcaagagattctcctacctcagcctcccgagtagctggtattacaggcacgcaccaccacacccagttaatttttgtatttttagtagagacagggtttcaccatggtggccaggctagtctcgaactcctgacctcaggtgatctgccacccgcccccccccggcttcccaaagtgtggaattacagacgtgagccaccacgcccagctgagatgggcactattattattcccattttatagttgaggaaactcaggctcagagaggataaatgattcactcaaggacacacagctggtaaatgatggatctggtatttcaatccaggttaacccagaattttaaacatgtgtatacacacatccatttatacatttaagcatatactttatttatttagagacagggtcttgctctgtcacccactctggaatgtagtagcatgatcatagctcactgcagcctccaactcctgggctcaagcgatccttccacttagcctcctaagtagctgggactacaggcatgcaccaccatgcccagctaatttggcttttaattttttttagagatggggctctcactgtgttgcccaggctggtcttgaactcctggcctcaagctatcctccatctcagcctcccaaaatgttgggattacaggcgtgagccactgcactcagccccattaagtatgtactttttaaatggaagcattgccttagagcagtggtgtacccttacggttccctaagtctctttcagggatctgtgggattaaaactattgtcgtagacatttgtgctcttcactgtgttgacattgtaaaactctccaagtgactgtaatgtgcagccagagttgagaatgacagacagatattctcgaatgaattgagaatcctacataaggaaattttatttaaaaatttaaatctatttcattatctgtatctcagttctttcaggcagggaaggagagtattattattatctcttttaaagtgagtattattattatctcttttaaagatatagcttaaggacacaggctttgtaatcaggcggaccttagttctgattccagctccttcatctgtaacaggctgggttgtactgggaaccttaactacgagaaattttagtttacctatttataaaatgtgagataatattaggtctttattcatactgttatgacaactattaataaaatacatgtactgtgaaagaggcaagtacattttaaatacataattattagtggctcttatttcagttggaaaggtaaataacttgaagctcagaagtggcttgcccaaggtaacatagttaaataaatggacaggtcttctgaatctcagcctcttgcctagtctgccttactgttacatttgttatctttctgaaatattttatgagacataagaaattcccaattggagaattatttaacaggttgtttgttgaataatgtgtctgctttccgaaattgtggtacttaatttatcagagatgtcacctcagaaaaggttgaaagtgttacctttattcagaggaacttctgttaactatttttggaaattgcaaacggatattttccacttttaaacttttaaataaaaaatatttagagaaaatatttactttgtggtaagattgcacttggttacaattaagtcatagtctaaaacctaatcatctctcaaagtgtaagcacaaaacaagcaagcaaaatctttatatcctcattataaaagtattgtgtaaggagggataggttagaaaagagacagggaagaatatatactgtattttgattttcgttttctgtagatggttagggtgacattagagtatatcagtcaggggaccatattaatatatatttgatatctattcctcatttttcactgaacattgtactgggaacattgttctttgtcattgggtatttcccaaaaacatgatgttatgtgatagtatcatttaatttatttagtcatttctttattgttatacatacaggttttcaatttttgctattataaatcattcttcattaaacattttcatttctttagcatagattcttagaaattgagtaattggaataattggaccaaagaatatgaactttttttaaaaagcccttgatatagatactgctaaaatttccttgcagaaaagttgttccaaaatataacctctactttgcctgtaatattatttttaaattttaacattttatttcaaactaattttagatttacagaaaaattacaaaaataatgcagagttcccatatactcctcacccagtagatgctaattttggcagagactaataattacctttgtgttttataccatattagtaattgagttattaagattctttatagtattgacatacagctaaatttatctctataaaagtttatgaaacaaaataattataaatttttacaggattttacaaagaattcacaagttggatcggataattcttcaattttactgtttgactcgacccaggaatcactaccaccatcccaagacataccagcaatttttagagaaggtttggtttagcactctttcataaaaattataaaaagagacttgtcgaatatacatatggaattgaatttctgttttgaagcccataccttcatgttaagtttttcatatattataacatggaatagagctaatcattcctgaatgcctttcttgggtgatatagaaaattgtatttagtgatagaatgttttatttatttctattaagttggctagcacatattctttgcactctttttcacttggaaccagccatggactgaacaatcttaatataatttctgtgagtcaaggaagtcccctgatgccttaaatactctgcgaaaacaagtagtaattatttggaagacacttaatatgagaaaacgtgcatggttatagttgatttctcaatatgctaatgtctttctattcaaataaatgatgtggatatgatagttaaatatgattatagagtagtattgtaaaatgaacgaactaaagaaacagtgatttccacatggtaagtactcagtaaatatactttgaagtaataatggaaattttccaattgaagtgttacagttctttgatgtccaccataacaaagttcttcattaacctaaaatagtatgccaataaaggaattttgtctcattgaaaaattccctataatcaaagcaattactattctctatattacctagtttgatatgtttcactaaatggaaagaggaacacaatttttttgcatatgtaattatttactcataaattagtatataacctttaccaaaccaaaacaaaaaaattatagtcatatgaatgccaaaaatattttcccatttttatattacttggtttgatattcacctatctaggtgtcacttatctagatagtaaaatagccaagaaccgaaacaaacagggagataaaacagttgttttaactcgggttttgcaaagcacatgatctttattcatggaaaaagtctgaattcttgaagcttccaaagggtaaagacagtgactcctactctctctctaagattaatacagcagagagtgggactttgtcctgaatagtaaataggattatagttgattgggaaggtacaggtttaagcctttattctaaagatttttgtggcttttatcaagtcatctaacctctttatacctcagttttctcacattattaaaatactttcatttttctcacataaagcatttattctccagacctgaaatgagccagccatttggatattcaattttaattcttgctctctttatctcagggcttctttgaggcccaaataaaataagtggaaagtgaaaaatgcattatcaattttaaaggatttgacaataaacagttgttagaatgataatcatgcatgataatatgtgctatatgttcagaagcatgattaatggactcctgtctaagatgatcatggagagttcttagagaaagttggatttgaacttgattttgaagaatgaggataggatttttattagcacagataagaagagttgaggtagggaacaccgcaagccaaacacaacacaaataagtaagctaaagggtcagaatttaaaactattgagctcaggttgattttatttaacttagattcatcatgcttaaaataagcatatattaaaacagtctattatccagctggttatataatcagttgcctagtccaaagtactagcactcattggttgttaaagtaacctaagcatctcagaaaaaatgttagtgattacacaaaaattagtcttaggtgccttcaatatagctggcagtaattatgtgctttgaggatggaaaaaatcatttctgtttaaggaaaaaatcatttttatctcaaagaatgaaacacagatttaacagaggaacccattaatgtaatacttactttcctggcatatatctactctactgcttctcctattaatgtacagttgtgagcttttaaaacacgacatgcagttttagaacccttatcacaaagtacaatcgtatattattttcaaaaatcacttttgctgggtctggttatagcctaaatagccccacatgtcttgggaatgccctgaattatataatcctttggtctttaaggtggtggctctcaaactcagaactatctttagcaatgaaattcttactcagataaaatttatgcagaaattaataaaacataaaagcagagtttctttatctgacatacccattacattttctaagatagacccattggattaaggggaacatactttgaaagtcattatactaactctaaaccttttcatatgaatgagtgaggtattatcattcaacattagttgtttctactttgtatatagggagtaaacaagataatttaaaccacctgttagtttgttcggtggaaaaagaaccaacttgaattttccattacacatcttaagttttttaaaaaacattaaaaatgtttctctaaacgtttggaataaattttttaaatattttacaaactcaaatgtatttaagcatctaaatataagttgatgtgtagaaacttagagtattccctgtgctataacttttatttattttatttagcttggaattttttggtctaacttttttcatgatacctgtttgttttctttatttgaaagcatttttagaatttgggtatataaagtttattttgtgaagtaaagatatgtagttcatagtagtagctgtttgtgcaatttctgcttgctcatataaattttaatcattctttattgtcatttgtatgatatgcttattaaattatattacctttaacttagttccaaactgtttttgctcagttttaaatgtaaagccattttggtagcagttttacataagcaatattccatactgaaatatttacaaatatctttctcactatttaaatctttgtaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtaaacatgaaatctgacatgtaaaaaaaaatagtattatttttatatacgttttagaaattgtgatgaattttaaaaccattattagtggtcatttaaggttttaaaaagatggatttgagtcttaaaagttcttaatttattgtaggtacaaatacctcatctccatatgatgctggagcagattacctaagagcttgtccaaagtgcaatgttcagttcaatcttttggatcctttgaaataccacatgaaggtaaaacttttttcaaagttcaattgttaaaaatgttttatagatccttgaaaatattgaaaattgatatacagtaaatgctggtttatccagatatttagagaagaaacctcgtattggcatttccatgtaacttaagttaaaattgatattcacaatgattatataagattttaaaatcctttccaatgatgaaatttttaaaataaagttatggatagaactggaagccattatgttaagtgaaataagccaagcatagaaagacaaatggacgttgtcactcatatgtgagagctaaaaaagttgatctcatagaggtagagagtagaacaatagttgccagaggctgggaagggtatgtgtggaggggtaggagaagaggaagagaggttggttattatgcacaaatatacagttagatagaaggaataagttgtaatgtttggtgcaaagtagagtgaaaaatagctaggagagagcacttagaatattgccaacgcagagacatggtaaatactcgaggtaatggatacctcagacatcctgatttgatcattacatattctgtgcacttaaaatatcacatgtaccccataataatttataaacattatgtatcaatttaaattttttaattaagttcatatgcagtacagtgtatgcatattgtattttatttttatttatttatttatttgagacagagtcttgctctgtcacccaggccggagtacagtggcacaatcttggctccctgcaacatttgcctctccagttcaggcgattctcctgcctcagcctcccgcgtagctgggattacacgtagcaccaccatgcctggctaatttttgtatttttagtagagacggggttttgccatgttggccagactggtctcgaactcctggcatcaagtggatccactggcctcagcctcacaaagtgccgggattacaggtgtgagccactgcgcctggcctgcattttaattttaaatgaaaataatgtacaaattgcaatattttattgactaaattatgacattcttcaaacttcctgtaaagcaggtgttttattaggtgcttaatcttttgtgtaaagtgaaagctccttttgtttaccttattttttgcccatggtgacatatccatgtcgcattaccctgtgaaaaccttatttttgcccgtggtgacttaatgcatgtcacattaccctatgaaaaccttagtcttacattttaattttcaacactcagaaataaacttctaatgatggagcatttcatatgaaatgatagttttaactcaatccataatatagtttatatagttataaatgaattctagctttctattaatataggaagctctttgaaattaggttttaggtaattttcacagtactaatagagtatgggattaaggtaacacgccacttaaaatattttagtagatattacagtattctgttatgtgtgtataaagatagtctgtattctctttgcatgcccagtgtaaatgacaggaaggggcaaaggaggcaagaaaaaagtcagtgttgattatatgtgggaaataagtgatgagacgagtgcaaagcaaagaagcaacttaggaaaaggaattgttcactatttcaaagattggcaaatttttattaaaattcagcattttacaaaaaaggaattctaaaattgcaaatacaaacgtctttactctgacgcaaaactgtattagagtctttggctgttttcacctccctgagtgtgtttgggaaaggggaatccaagtctcacattaccactgtttcccttgatatcttccaattctgtttcatggtgttgctctttaggacatagatgtatccatctcttacgattcattgtgggtgcaccctttagcatttttatagtgtcctttttgtctgttcagtgctttttgtttgatatcaggctcacaacccttgctttcttattgtttccacctgcctgttatattctttgcttatccttttactttcaaccctcccaaatcactttgtttttgttctttcttgctttcaccagagttttttcttttgtgatcctatatgaaaacttcttttcttttagaagttgagttaaacccatgtatattcattggtaggagaaatttaactggtctgataggtttaattggtcttagttttgtcacaatgctttgttatgctttctttgtccttttttttttaaaaaaagtctttcactttgtgattttaggaaagtttttcttttgttttccacccttgttttagtgtgtagtcttgtctttatttaacgctttatttagtatttatttagtatgtagtcttgtctttatttaacactttattgaggtatgattgacctataaaaatctgtatttaatgtatacagcttgatgagtttggagctaagtatacatccatgaaaacattacaatttgtgtcataaacataaccatcaccttcaaaagtttcctcctaccctctttattattattacctttttgtgatatgaacacaatagaaaatctatgcttttagcaaatcttttttttttttttttttttgagacagagtttcactcttgttgcccaggctagagtgcaatggtgtaatctcggctgaccacaaccgcaacctccacctcccgggttcaagcaattctcctgcctcagctttctgagtaaccgggattacaggcatgcaccaccacacccagctaatttcgtatttttagtagagatggggtttctccatgttggtcaggctggtctcgaactcccaacctcaggtgatccgcccaccttggcctcccaaagtgctgggattacaggcgtgagccactgcacctggccaaatttttttaagtatgtaatacagtattgttaactatatatgcactattctatatagtagatctctaggacttattcatcttgaataactgaacctacataccttttgactaataccttcccattttcccctccctctagcccctggcaatcacaattctactctctgcatctatgagtttgactattttagattcctcatataacagaaatcatgtaatatttgtctgtctgtgactgtcttattttctttagcatgttttccaaatccatacatgttggtgcaaataagatttctttctgtttttatggctgaataatatttcatttgtgtgtgtgtgtgtatatatatataccacatcctcctcatccatttgtatattaatagacatttagattgctttcatgtcttggctattatgaataaccctgcaatgaagtctacctacatgggagtacagatgtctcattgggattccgatttcaattcctttgggcatatatacagaagtaggattactggatcatatggtagttctatttttaactttttgagaaacctcccatgtcttccatagcgactgcaccaataacattcccatcagcagtgtaaaatggttcccgtttttccacattcttatcaacacttatcttttgtctttttgatatagctgttctaataggtgtaaagtgatagctcattgtagttttggtttgcattttcctaatggttagcaatgttgagcacctttgcacatatgtgttggctactcataagtcgtcttttgtctattcaattccttgtgcccatttttaaattagtgtatttggttttttgctattgagttgtaggaatttctcatatattttggattttaaccctttctcagatagtttctcctatttttttatccagttattcttagagaattcttctagagaaattctacaactgtaaaatatatacaataaataaattagtttcatctcattggataaaaaaggcttatatatgaaagtattccaattaggatcagtttatatgatgtcttgattttattcatgaggtagatttccccttcagatatttaggcattctagatagaatatgttgagatattcaaaatgtaactgatgcttttttgtgtcccacacattttctagcatggtaagtctggagaatggcaggttagctgtgctcaaagtctagttccaaccaggcttcacttaaatattactgtgttatttgataatcaagcttatacataatggcatgtaaaactaccttttaagcttttttttttttttgagacggagtcttgctctgtcacccgggctggagtgcagtggcgcgacctcagctcacttcaacctccgccttacgggttcaagcaattcttctgcctcagcctcctgagtagctgggactacagacacgtgccaccacgcccggctaatttttttgtatttttaatagagacggggtttcaccatattggccaggctggtctcgaactcctgacctcgtgatccgcctgcctcagcctcccaaagtgctgggattataggcatgagccaccacacccagcctaagctattttttttttaattattgtagattcaggggtacatgtgcaagtttgttaacaagggtatattgcatgatgctgaggtttggacttctactgatcctgtcacccaaatagtgaacatagtacccaataggaagtttttcagcccctgccttcctccctccctcccaacttttggagacctcagtgtagtttccatctttatgtctgtgtatacccaatgtttagcttccacttacaagcttccacttataagtgagaacataagatatttagttttttgtttctgtgttaattcatttaggataatcgcctccagctgcatccatgttgctgcaaaggacgttatttcattcttttttatggctgtgtagtattccatagtgtatgtgtaccacattttctttatccagtccactgttgatgggcacctaggttgattccatgtcttcgctattgtgaatagtgctgcaatgaacatacaagtgtaggtgtctttttggtagaacgattaattttccagtgagtatatacccagtgatgagattgctgggtcaaatggtagttccatttttagttctttgagaatctccaaactgtttctacagtggctcaactaatttacattcctaccagtggtgtataagcatgtaagctgtatcttgacacagatatgaaatgggtgattttgggccaagaaaaatattattattaaatatttacatctaaaaagaaaaattgcaaggaaaaaatattagatacataaacatcccctgatcttaaggttttcaatattgtttttgaagttattcctttattaagatagtaggtgtttattgtttgaatttttttagaatatgtaaaaatggaagccacaattttggtcagtatctttctagatacattgccaagcgtagttttatatcatctgaccttagatgtaaacacaatcattttttggtatctaatctttaaaagagctgtagacaaggctcatatttttttcctctttcagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtatgtaaatatttatttttatttctgtttgaaagttgggatatgacagataagaatatagtatctttacattgctctgccatcctcggtaattaattctaatactttctactaagaacagtggcagattatcatgttgaaaagcttttgttccttcttgtattttaagagtttgactccaggatccacctagttgttttgttttcagatagcttaagaaaagacaaaatgtattttaatttaggggaaaactacttattttccctacatttattactgaactagacggtttcatgaaaaacttatattttctagctgactttgaatcttacttttcttcatgtcacaagaagaaccctatgcagcatgacctcctccatactaaccttatttaaagctcaaatttttccattttaaaataaattgcaggcgtttaccaaaaccaaagagaagtgttttggaggtgtgaaaaaagataaaaacccaaaccttcacaatgattgctatgtaggttgatgacattatcactttgtttcaagattattttctttagtgattcataataattgtaagtagttgacccagtcttaaaactgttgtttacattgaataactttactttgaaattcagcaaaaagttttagtaagccctttgaaaatggtatgtccatttatattgtactctctgccattgaacatcatagttccttctcttcagaagcctttcagagaagctaaaatagcagaaggtaaaactgaaaaatagacagtgctacaaagggcacagcctgctaagaaaaatgaatagtttgtgctaacagtaagccagtataattagataaaacaaaaggttcttgtaattatagtcattaaaattgctattgcatgcatttagaaaccaagacacaaataaaaatataccagcagtttgtcttttgagcagctgaaaccttcagagctttcaaagatttgtctcttcactgtagctgcttttggtggtagagtttccatcctttcagtattttattttaaaatgtaaatagtatttcatgtatggaaaagaagcctgctatttttctttgctaaaaaaaattttaaatctaaaataatgatatagtgttacagcaaattagtgatgtttcatactactacattaatggattattttagaaacaaagataaaaaaaccttactgagccacttaatgaaagtaaattatttaaagtacacactttatagagtgctttcaggccttggagatgttattttgagtcatagaattacattttaaaaatttattttcagagacttatttgtgaggtttttctttggttataagtctgaatttttgctcttactggcaaattgtttgtaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctagtaagtgaaagtttctttggaatcctgaatattgttgactttgatcatccgaactgtgaggaaaccttaaaaattctggcagaaaaaaataagaagtagactttgtaatatgagggcaaaattgaaaaaaaaaatcataacttttataaacctagatgaaatgtgttctaaagccaggtgtgatggtgcatgcctatacacccagctactgaggaggctgaggcaggaggatcacttgagcccatgagttcagtactatagaatgctatgatcaattgcacctgtgaatagccactgcactccagcctgggcaacatagtaagaccctgcctctacaaaaaaaaaaaaaaaaaaaaaaagtagaagaaaaaaactgttaaaattgaagtcccttggtcgggcgcagtggctcattcctgtaatcccagcactctgggaagccgaggtgggttgatcacctgaggtcgggagttagagaccagcctgactaacatggagaaaccccatctgtactaaaaatacaaaattagccaggcaaggtggcgcacgcctgtaatcccagctacttgggagactgaggcaggagaatcacttgaacccaggaggcagaggttgcggtgagccgagatggcaccattgcactccagcctgggcaacaagagcgagactccatctcaaaaaaataaaataaaataaaataattgaaatctttcttataaacaattcattagtggaaacttccttggcacatgcattggtgtaggggactaaattagaacacccagattccatggttttcaaatttgaagttaattgtcttgatttacactttagacaaaagttaactacaatgttaagatttagagtctgagacgcggacaaatttggttcagattccaactttgcctcttactacagctgtgagatctcaagcaagtttcttaatttttctgtgcttctggttcctcatctgaaaaataggaataaaaataacagtaccttcctcagtgatgttacgagaattaaataagctaatatatccttggaacagcattacagagtcaacagctatagaattgttagaaccacatcactgttacttctactattattattacttgttgtggatgtacaaaatgaatctttttttatatacatccttaaatggtataatgtgtttttttccactttcagctatttgcaaaatctgtgaattatcatttgaaacagagcatattcttttacaacatatgaaggacacccataaacctggtgaaatgccatatgtttgccaggtacacacacattttattgtgtagttaagtgtttgtttaattttcatgtgccatgaaatagtattgttcttttgattttttaaagccatttaaataaaattagttactatgctaaaattgaagaccctcttcattagtggaaacccccttgggtttaactcatgcattgtaagtaaaggggtggagtagattttgcctgtgggttgtagtttgctgacctctgtgctagatgaggaaatgccctactagagaaagacaaatgtgtgggttatcatatagggaaaattatagatatgctagagaaataggaaaatctcttagttatagaataccaaattaaatgctttgggatcagtgttccagaatttgaagtggcttccagtaacgaggaattgagatgaagataaattgacactggcatagcatggatgctatttaaaatctaaagaagagaatactctgttttatatagcaggaaaagctttttagaacaatatttggcagaggttgaaaattcacatcaagatagggggtggtagatttgaaaagaagaagagagtcttactgtgttttggaatatatgcctaaactttgaaagatatctttcaaaggttatctttattacttgcagtaatatgattcttggttgtataggcagcagagctggactagtagtacatgttcttccaaacagatgacccgttattgctactttgattgtaattgcaagaagttataaaatatcaagttaaactaagccttctttatatttctaggtttgccagtttagatcatcaacattttctgatgtagaagctcattttagagcagcccatgaaaacactaagaacttgctatgtccattttgcctcaaagttagtaaaatggcaaccccctacatgaatcattacatgaagcatcaggtgagattaagcagttcttatttgttcatgttgtcttagtgaaaagatatagatctatatgtatagatctatagctacatctatatctatctataacgtagaacattggttagatttgttctggacagaaagcaaagttgttctgaatgacacaattaatttataatttatgctgaataacttgtgaaactttcacttattttccttgcttgctttctggtgacactgagaatcataaatagtcaaagttctgaaagatagctagaaataggaaccccaaagtggaggaaaaaacagaagattcatgaaatatttaggttagatatttcaggacctaagggtggtgggactgggaatgactttgaaggtgcttatcaagagcaggaaaaagaataagtttgaatggaggaacataagattaaggactcataaccttgtattttcctctttctcttgaaatcttatttctactttctagcccactttttattatgagacatgtggttgtcatcagtgacccagaattgacttttgtagcagccagtaacaaaggaaacagcaagaacacttatgaccagatatgtgaactatactagagaactatatttaggttataacttacttactttgtgacttttgccagttctgctatataatttctgggataccagtattgatgcttgcatctttcccttgaattctgattttatgcttactgattcttttcctcaattagagcatcctgtgggctgaaaactttgatgaaacagtgggcctattcttgagtgtttgaaacagcaatagtgcctttgccaaaatcagaagtcaacggatttactaagtctggtcatgtaatcaagttttgcctcctcactgatcagctcattacattttcgtagtattgattgcattgtctcggcaagttgattcagtactggcactaacgtcgcccttgaatgtagtcattggatgatcatgaaatcaacttatagttgttaattggaaaaaaagtcataaaaatagaatttccaaacacattcagattacctgtgttatgacttggatggtatcagtgtcttttttttttttttttatcctggtaggccatctcacccttaaaaactttggcaaaatctttctagggtttccaccaacagtgttcactcagatgttaataagtgttcccctcttaacttgttcctggtaaaagaaatttagtgaatggctggatttacaaaattcatagaggtgttttttgtttatttttaacaacaagacttttcagagcttttaatatgctaatactgtaaatctctaagcaagggacatagtgtgtaatagtcctcaaacatttttaacctttgagccctttatttgcacaatacctattaacatttcttgaggtatagagtttgggaaacactattcttggtggtctgtatttcattttttggccttcaattttgaaaagaagaatggaacataaagcagtatctctgactgtctaattatgggttttttaacataattctttcccctgtgctttactaagctccagagtgatatagatgtagatttgaagggagtgataacatgcttagaaaggtaagaaagacataatgaacccactttgtgagctgtgtcttataagtggtttatctgatctgtagtcattcttcatatcctaagttgtatgccttaacttgctgtatgtattggaaagagttacccaacaggtctgagttgctcaaatattgcacaatttcagaagtgcctgcttgtataactggcccttggctaaatcttggaaattgagcttctaaaatgttctctatgttattaactgataagagtggtttacatgcctggaaccttgagccatgttgtaccagttagtcaagaaaattcgcacaaaaaaatacggttatggtgaccacctgcttttcttgcagtgggaggagtcgtctgaaaatttggtggcttacctccataaaaaacctaagctcttagactcaagagagctttcccatcaagcaacactttatacgtgttgctgcagttcattgctgagggattttatacatgttgctgcagttcattgctgagggattaagtgtgtcctatgtgactccattggaatagagctcttagaagttggcgcctggtaatcctctagaagctatccagtacaccattttcctttattaatcctgctctgtacccttacactgtaataaaacatagctgtgagtataacactaagtcctatcgatccttctgctgaatcatcacatctgggagtagtctgagggaccactgaggtgccacaggtgctgtcttagtctgtttgagctactataacatgctattataccattgactgggaagcttaaacaacaagcacttatttctctctgttatggaggctgtaaagtccaagatcagggcaccagtggttcagtgtctggtgaggacctgcttccttgttcatagatggccatattctcactgtgtcttcacatgggggaaggggtggagagggctctctagggtcccttttataaggacactaatcccatttatgacagctccaccatcataatctaattagtttccgaaggctccacctcccaatactattacattgaaaattaggatttcgccatatgaattggggggcggaggggacacaggcattcagtccatttcaggtgctgaatttttttgttaagtttggagtacctgaagagtaaacagtcagcagtgaagaggtaagattctattgataagaaggatcatcaggcttctctgaaggtatttgcagtttgcataattattcacaaaagactcaaaaacctgagctgaccaatattataagcttataatttagatggcattagtgcaattttatgtaataagaattattgactctatggtttattttattctttttgaaaactttgattgcaactttttcctaaaaataatatattattatgtcttgagtgattttggagttagcaatgcagtttatacattttttaacaaaggacgaaagactccacatgtgttaaatatcctcattagctctttaataacaacaataagcagttaacatataataatcacttaccatttgacagccactggtgcttttacatgcattatcttgtttaatcttcacagccaccctatgaggcaggtatatgattgttttcattttatagatgaggaaacaaagctttatagaaagtaatttgcccagtgtcacattccctaacaaatggcagagcccaaaattgatttatagcccaagcttccaccgcagactcatattccacattgacattaggtctaaaggcagaaattacagatagttacccttgaaaatccctcaaattggccaggtgcagtggctcatgcctgtaatcccagcactttgggaggccaaggcaggcggatcacctgaggccaggagtttgagactagcctggccaacatggtgaaaccctgtctctactaaaaataaaaaaaattagctgggtgtggtggtgcatgcctgtaatcccagctactcgtaggctgaggggggagaatcacatgaacccgggaggcagaggttgcagtgagccaagatcatgccactccagcctgggagacagagcaagactccgtctcaaaagaaaaaaaaattcctcatataacccaaaaaccatatagtatgcatgtcaagaagttcaacacttaactttttctctacccttggaacaagttactgtttctttggttaaacattattttaaaaatgtattagttgggcacagtggctcatgcctgtaatcccagctctttgggagaccgaggagggtggatcactggaggtcaggagttcgagaccagccctgccccatctctaaaaatacaaaattagccaggtgtggtggcaggtgcctgtaatcccagctagttgggaggctgaggcaggagaactgcttgaacccaggagacggaggttgcagtgagccgaggttgtgccattgcactccagcctgggcaacaaaagcaaaactgtatctcaaaaaacaaaaaaaagtatcatctgtgatcattagcacaatgcaagcatacatacataagagggatatccaggacttgagtccaactaagggaatagtagattaatgtctcccatcttggggctctggacaagtaaatactcattgaatgaaatggcagacactttgaactagttaaattgtgcctgctgctcatttgtactctgtcagtctcttgcctcactttatttctttatttaagaaatatttgagtgcctaatatatgccaaggactgttttaggtactggggatacagaagtaagcaaagcaaggtttgtactcactgaaataatgcatcatggtagagaagggtgtgtgtgtgtgtgtgtgtgtgtgtgtgtgtgtgtgtgtgtgtgtgtgtgtgtggtgtctgaatgtatatgtatgccagctgatggtaagtaccatgggaagaaaatataggtagatagagagtgccagggctcaggtgaaggagtggtttctgttttttaaatggtgtggtcaaagagggcttctccaaagggaataagagagtaagtcatgtggcttactcatctgggagagaatgttccaggtagagggaacaataggtaggcagtgaagtgaacatatacctaggatattcaaggaagagcaaggagaccagtgtggctggagcacagtaaacaagtgagaggaaaagtagtaggagatgaaattgtagcaagagaatgtaagccagatcatttgaggacttgtaagccagagtcagaattctggagtgttacggaaagccatttggagggtttaaccatgtgaaagatctgtaacattttaagatcactctgacagctatgggaagaacagactaggagaaaggatggaaatagggagaagataggaggctcttgcaagagtccgcgtaagtggctcagacaagtatagtagcagtgattggaggtgatgagaaattgaaagattataaatttttttttaaggtatcactgacaggttttattaatttgttgaatgtgggatgtaagagaaagagaagagttaagagtgaccaagtgttttttgtcctgagcagctgcaagaatttagatcccatatactgagatattgggaagagtagggaaggaacagattttgtgcccttccccactcgggatgaatgagagggaatctagagttcaactttttgtccatgttgatttgaaatacctattagacatcaagagatgtcaagtaggcggtgggtggatgctatttaaagccatgaaactgaatgaggtataggtataggtagagaaaaaaattgtgggaactgtactctgcgggaacattctatccatcatcttaatttgctgtctattacttagctgagattttcttctttccccttctctcttgagcacctacaggtaaatctgtttgtgtttactgtacctatggtatgatccagtacaccacacttctaaaatagtctgaagatcaaactaaaatagtaatgcaaacaccttatctttatatattgctttgaactttgtaaagagcttttatttagcaaatgctttttatgcaccagtaactactagatactttcatacatgttacctcgtttggttttcctaaaagattgtttgtgttttatatgcaaatgatgagctggtggagatacatctttaaagaaagctttcttttgtatttgtatgttgttctaaatttataataaatataaaatatattttaattaataagaacatatgcataaagatggcaattgtatagtagacagaacactaaccagctatgggcaagtgcaaatttctcttgggtcccatttcccattggtaaaataataatggggctaggtttgaggagggatttagtcaagggtttctcaaacaatagattgggatccactcgtatttatgcctctataatcagtatagaacttttccaattaaaatctaattatatactttttatgtttgatccttatatggtaactaatgcttttgaaactcaaatactaacacaaggagtacttttaaataatagatcactttgaattgtctgtggtgggagatggtaaaattctggttgtaaatttatttagattttagaattaagagcaatttcagctcctaggatttgtggtggtggaagttattatatctaatattttctgtaaacagaaaaaaggagttcatcgttgcccaaaatgcagactacaatttttgaccagcaaggagaaagctgaacataaggcgcagcatcgtacatttataaagcctaaagaactagaaggattgcctcctggagcaaaagtgagtttgtgagggagtttttggtggttttttgcacattctattaatttttttatgtttttttttttattatggatagaaggaataagatctagtgttagaaagctcactagggcaactatattaacaataatttattgtgtatttcaaaataactaaaagagtggaattggaatgtccctaacacaaataaatgataaatacttgaggtgatggatacccgttaccctgatttgatcattatgtattgtatgcttgtatcaaaatatcccatgcaccccaaaagtgagttttaaatatgctgtatttttaacattttgtatgataatagaaacaaactactgcctggttttatctattgaatataatattaaaattgacctctgattgttattaagactttaattttaggttttatcattcttatgcttgtaaagaaaaacttctaaccattgttttttttagttgattgatgtggtttgttggagggatatttctagtgcaactagattgtagactaagttggcaggtcgtttcaatgttctgtaggctgtttttgagctattccagttgtcagtgtgtatgtctttttcagttgctagactataagatatttaagatcaggaattatatttaatttatctttgtgtccccagcatctgtcacagtgccttgaatgccataggtttgttgaagttagtattactaatctactctcagagaagcaagttttgctcctggatagcatagcattgctgtttttcatgagcaagcacacatcagactacaaatttctttctccttctttgccttatatacatatgttttcgctgactttttttttttttttttttttttttttgagacagagtctcactctatccctcaggctggagtgcagtggcgcgatctcagcttactgcagcctccgcctcccgggttcaagtgattctcgtgcctcagtctcccaagtagttgggattacaagcatgcagcatgatgtccagctaattgtttgtatttttaatagagactgggtttcgccaacatggccaggctggtctcaaactcctggcctcaagtgatctgcccgcctcggcctcccagagtgtggggttacaggcatgagccaccacgcctggccctctgacttctttacataaagttagctcttgaatattttctccagtaaagagatagataatccaaggtgagataatccctaaacatttgtatttcactttgagtacatgcttttgaatgcgagtatgtctgctatttaaattaacaaaattaatataaaacaattatctgaatatctagcataagataaaccatctggcatccttccctgcaatccatttgttccatgttggtattagacatgcagaatattaatgtaggcagtacaatcctctctcacatcttcccttattaataagataccaatagtaatgataatattgataataatgatactatatgtcttatagcactttagaattaagtgttcggtgtgcctttccatacattttattatttaacctatgtggtgatccagtgatatagacaaggcaagtattatccccatattagagatgaagaggctcagagaggctaaattccttactcaaggtcatgtagctaggaagaggtagtactaagattcttaaactcaggtcttttgacttctactctagtgctttcaaaacatgtattttctttttgcaagctaacaagttctgcttcagtgcttttctataccacatatatttcataggacttcatagaagctgttcttcaagtacatggggggagtgtaatcaaatgattaaagaaaatgttagtggatgacttttctattattaaccaatagatacaaacattttctttttccaaatagtaaatgataaattttatatgttaccattaaggaaattctgagcattattataaccaccatgctgtgtgatgaattgatataagctcaccataaccttggaagcagaaatcatgccccctgatcccccaggaagaggtcacatttactgaaaatctgttttatagttaccagagggtaatgcaggcctttccagagttattatttcagacctctatattacattttgacctctctatttgtgaaagccttttagttagttgggtttttttgtttgtttgtttttgagacgggggtctcactctgtcacccaggttggagtgtagtggtgccatcttagcttactgcaacctctgcctccgaggctcaagcgatcctcccacctcagcctcccaagtagctgggaccacaggcggatgtcaccatgcccagctaattttattgcatttttggtagagatgagttgcccaggctggtctcaaactcctgagctcaggcagtccacccaccttggcctcccaaagtgctggggttacaggcatgagccaccacacccagccctttttaattctatcaaagcataaaatagctatggaatgtgctcttttgatatttatctaatttttactcctaattattcgttaatatctgttaacatacaactgttatcaatataaaactaatattacaacagtaagtaaatatcaagataaatttcatttaatcagtatgaccatttagaataagtagaaggcttatctgattgtagtttatacttgccattttcaaaataatgattttaactttttgtattgcagtggttttttggtaacagtgttattgagatataattcatatatcacacaatttacccatttacagtgtacacagttcagtggtttttagtatattcagatttgggcaaacatcactacaataaattttaaaacatttttatcaccctcaaaagaaacctcataccctttagcattcactatttcccctccattagacctgtgcaaactttagtctgcttttagtgtctatggattttcctattctggacgtttcatataaattgagtcatacaatatgccatctttagggactggtttctttcgcttagcataatgttttgtaggttcattgatattgtaccatgtttcagtacttcattcttttttgtggctgagtaatactccactgtatagatattctacattttatcctttcatctattggtgggcatatgggttgtttcctctttttggctataatggtgctgtaaaaattcatgtacaggtttttgtgtgaacgtatgttttcatttctcatgggtatatacctctgagtagaatggctgagtcaaatggtaactcttacctttaatattttaagaaactgccaaactgtttttctttttttgttcttttgttttgttttgtttttgagacggagtcttgccgtgttgcccaggctggagtgcagtggtgcgatcttggcacactgcaacctccgcctcctgggttcaagcaattttcctgcctcagcctcccgagtagctgggattacaggtacctgccaccatgcctggctaattttttgtatttttaaaagaaatggagtttcaccatgttggccaggctggtctcaaactccttacctcaagtgatccgcccacctcggcctcccaaagttcagggagtacaggcctaagccaccacacccagcctgccaaactgtttttcattgtaactacactgttgtgcattcccaccagcaatgtatgagggttcgcatttctctatgtcctagccaatacttgttattgtctgtttattatagccattctggttggtgaagggacatctcatttgggatttcatttgcatttccctggtgactaatgacgtggaccatctctttgtgtgcttattggccgtttgtatatcttctttgaagaaatgcctattcatctattttctctttggttgcttgtgcttttggtgtcatatataagaaaccgttgcctaactcatgctcacaagaatttactactgtattttcttctaagagttttatagttttaccttttagaatttggtctttaatacattttgagataatttttgtatataatatgaggtaagggttcaaattcattcttttgcacatggatatcagtttttgtagcagcattcatcaagactattttttgccccattggaaatgttttgggacccttgccagtttaccgtaaatgtgatatttacggcttacaatgatatttttaatactaatgcgatggttacttttctaaaaatatgtattggctttgtttttataggttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtaatatcttttattcctgatatacaatacaaatttaatcttatgtatataatttatcatatcataaaaccctcttacacatttacatgataatcacttatctggcataaagaccaagcaaatgagaaaaaggtactttttacaactgctgagcagaacttgagtcattgtgtttattctctaattttcatcttttacactaaacttatattttgtgcttttatcttatgatagattaattggtttatttgatcccttttattccagggaaatgttaactggtgttaaattttttacacttactctagcttgtttcaaagcaaattttgaaattatgagtctacttaaagataccaatttaaacattttggcttcagttaataaaatgttaataagattttcccctgttatttttgttttataatctctttttatcttttttttccgtctccataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgaggtaagttaaacatgtaaactgccaatcagaatttccatttgggtcatttgttttttgaaaacagagttatcctattgaaagcaagtttgtctcatcaaggaactaaaagggtctagcaatagggaacttctaagatgttccttgtactattttccagcatagtaactcataaaattactgggacaaaaactctgagaacaattagactaatgaaattaaaatgagtttgttagggaaatttgttttttctatgggacttttttttcttttatgtctttcaaaaagtggttattttttaacataaaatgttaagtgttttcaatatatttatcaaataaatatgatcagctcttgcattccacatctgtggattcaaccaactgtagataaaagtgtttttaaaaaattaggtctttactgaacatgtgcaaacctttttcccattattctctaaacaatacagtataaaactatgtaatagcagttacattgtattaggtatcataggttcacaaatctagagatgatttaaagtatacagcaggatatgtatagtttatgtgcaagtactatgccattttatatcagagacttgagtctctgcagatttggatacctgcaggaggtcctagaaccaatcccccatggatacagggacccctgtatatgtaatttcctgagtgttatcctcttcacagcgatcactttgagaggttccaggctttttaatgatgctaagaacattatcctgtctctgtctcccgcatctgtctgtccatttgtctttatgatcatccatctttgcattcattcaatgaaacataagagactgtaggaatattccagtcatgatgctaccgttagaattccttttcatgcattgattcaacttaatttgagcacctatggtctactctacacaagggaaagacttcagagccccccttactttcatttgaacctcattcacaggggcttgctttattccttcagattggattttattttaaataaccaaaaagtttccagatataagttcattattctaattaagatagttccatttattttcagttagaaataagatacaactagccaggcacaatggctcatgcctgtgatcccaacactttaagaggccaaggagggaggattgcttgagcctaggagttcaagaccagcctgggcaacatagcaagacctcatttctattttttaaaaaagaaataggtataaccaataaaagttgttttcttgcagattataacaagacctctatattattttctgctcataatcagctaccactttgaaggattcacccacgttttttgatggcttcagcacctggcttgcagggatttttttccctttggtggtcagcctgaccttatgatacctttacttctttagtgctagcactttacatccctttctgctttgttgtatcccctttcttaacaccatcccattttacctcattgtagacaatacttattttgaattctcattaccccatgactttcagagtcttgacccctttttctagtccagtagtatcaattcaattttgtagccaaccatgccctcaaggtcttctgttttgaatgctgctttgtttctgtcctaaaatcctttatatcttcaggcatgcttagtcttgctatctttgcatcttttatcctttttgatgtatccctatgctcagttctagactaccacaccatgcttgattcaatcagctctgaattcatgatctttaatttggtcctgcccttttaaaaataccgctttgtttttgtttcgttttgttttgttttgagatggagtcttgctctgtcacccaggctggagtgcagtggcatgatctcggctcactgcaagctccgcctcccgggttcatgccattctgctgcctcagcctccccagcagctgggactacaggcacacgccaccacgcccggctaatttttatttttatttttattttttttgtatctgtagtagagacggggtttcaccatgttagccaggatggtctcgatctcctgacctcatgatccgcccgcctcggcctcccaaagttctgggattacaggcgtgagccaccacgcccggccaaaaataccactttgtttttatctacaacatctgtcagattttattctagtccctcagttgttaaccttgcctaataattactcagaggtcatacttttcgtttttctcaagattaactttttcctgtctcaaggttttttttccttcagacattaatctcaaaaaacagacatgtcccactttttttaagttaaccctgttcgtcatctcttgcatttcctccacacccttatttcattattttggaccttcagttcatctctttctctctaccacattcattgtgtctgtagatattttcaggcttgtttttaggatgaggaagatctgcctttactttgcatgctttcttgttcctccatttaccatcaacatttataaagagtattctttactagcctgtttgtcattttttgactctttgtgatttgagtgtcacccccccaccccccaacgccacctacatacagctaaagcttctcctttaaaggttatcagtcatatcctaactactggatgtactcattatttttcattcttactcctctatgacttcttcagagtatttgacatttttgatcacttacttttggaactcttctcaacttctgtctgttaaactgttaccaccatttttcttctttccttttggctgctactcctctatgtaattatcttttctcccttcaactgttcttgtccccttataatccctttcttggtaccttaaccattcttaaagttttatcttttacctttcaactgtaaatcctctagatttcaaagccgagtttccctgagacccaactgtttgtttctaactaggattcaaaccacttttacttcaataccctttaagctcagtctgtttcagggcatcatttgcataaacatgaagcaccagctagaaataatttactatcccaagtttctgaagcccatggagttctcttgatctgccactatacatcctagcttccggagagtccaccttttgcagtttaccagtctgcctcttccactactacagtggttctgcacctataccccagtttctctaaagcagaccctagccaacccttcccccagtacactgctgtgattaatattgttctcttattctgtgctaaacacttggctgccctagtgaggctttaattctgccactaatttatagaggattaaattggaaaatatttttggcattacttaaacccatgtgtcattccgtcctcccctctcccattttccataggctcaccaactgtcttgtagaaccttcagccccattctatccccagacattcccaattgacctaaagttaccttcataacattttcctaatttctggtgagcccctgcactgtcatcacacacattgagctcttactcatcattaacctcatctagaactgaaagcttccacttctactcttctgagggcctcgtaggtccctttgcttttcccctacttcaagggtacactgtttccctcattgcttcaggtaccttcctctgaatggtgcaccctcactcctactcggtgtggacttttgtcataggtttgagttctgtatgttcagaggcttcattttctcagaggttgagtacctttattcccaggctatgccaactcttatgagaagacaggccctcaaaattgatctatcttccccaatgtataggctcttcatattcagtatctaaagtagtttttcttattcttgattattctctgaaatgcccctctccttcctctcgtttcaccctctgtgaagtatctgatcagcacagccagtcacaagaatcattcctttctttgagttccgtaacattctgctcttctgcctcacatgtgtctctattacctctttgagaaagaagctctttcgttgtattcaccatggtgcctattctgaggatgttttcttggaattacagctagccagaatctttattttcccatgcatatatagtaagctggtgatggttaccttgtgtctgagggtaactgttgacctgctgtgttgggtctgtcagtgcaagatagggctagtgcttctcaaactagcttgcataagaatcagctggaaaacttgggaaaacagatttctgggccccactgccagagattagttcactatgtttgcagtaaggcctgaaactttgtgtttctaacaagcttctaggtgatgctgatgatgctggtccatggaccacactttgagtaatactgtgctaggctaatcctggctaatcttgcctggttgtctaacacaggaaggctttccttatcattttaaagggaggcataaaagctattaccattggctgtgaagcttgattagtggttttctgatctgtgtgtaggagaagcattgttttaattcatgagctctgctccttaatttgctctctttgaaagttctcctggtaattgcaaaggactctttaaatgtttcatgtttattgaattaagcaatggcctttatctcaagtagtgtttacttccaggatcattcagattatccccctccccaaacatattaagattaaaatgtaataagtaattattattttccagcctgggtgacagagcaagactgtctgaaacaaaaaataataattattataacaatttctatcatagcaaaatacattatcaaatatcctttaaattgttctcttaatagttaaaaaactttaatttgacactgcatttttaactcaagcattgtttttagtaatggtgaggtactgatcatctaagaaaattctcagggaaatatgtcattagaaaatataaaggtaaagtggaatgtaagttaaaattcttgaattaaacagagatgactgtcttcgtccattcaggctgctataacaaaataccatagactgggtagcttataaacaacagaaatttatttctcacagttctggaggctggaaagtccacgatcaaggtgccggcagattcggtgtctgggtgagggcccattcctcatagacagcaccttctcactgcgtcctcacatggtggaaggggcacactggctctctaggatctcttttataagtgcactaatctcataagggctctgccctcatgacctaatcacctcccaaaggccccacctcttaatgccatcactttgggggttaagattttaacatgaattttggggtgacacagaaattcagattatagctttaaccaacagaattttattatttagatcatgatcttttattcaaaactaagaaattaagcattggcttgaaatgtggtcagaaaattaatatggtgttgtataataaaattaataaaatcttgtttgtctcgtgtttctccagctctcatagcaaccatccaggtaaacggttttgtattttcaagaagcattcaggaactctcaggtaatcattgatcttttttttttctttcaattgaaatattgcagtaactttttaaaacttgatgttggagtgcctgctttggaaatgatagagttctgtttattatgtccttggaccaaagttggagggatagcctatcatctctgactaaactctgtagtgccaagcattaagatgaaaccttcatgtatttgcgtttgtaaaataacaaaaataaggttctccaaccatatctgaatagaagtaagtttatgaaaataccataatacttgaaatcaatatatagccttcataattgttaatgtttttagaattaaagtatataagttgtttactgtacagaaaaaaaattgatgaatatttctaaaggcattgataattaccattggttacaccacacacatttagctcagaatcaactaaacatctgtttttttacattattttgttatcttttgactccatcttcctttgttaattattttgctcatgttgacagatgtttgccaggcacatagtacctggcacatagtaggcacttggtaaatatttgttgaataagttaatgtatatgttgaaaatgaattatgtggataatgttggaccaacagctcatagaggaaatttttattgtatttttaaaacatactcatgttaggccaagtgcagtggttcacacctgtaatcctagcactttgggaggctgaggcgggtggatcacctgaggtcaggagttcgagatcagcctggccaacatggcgaaaccctgtctctactaaaaataccaaaattagccgggcatggtggcaggcacctgtaatcccagctacttgggaggctgaggcaggagaatcgcttgaacccggagggcagaggttgcagtgagccgagattgcaccacttaactccagcctgtgcaaaagagcaaaactccatctaaaaaaaaaaaaaaaaattatgctatttttaaagcattgaattcgaggaattagaaaagagtaaaatatattaggtgttacctttactgaaaaatgcttataagaatgaaaagagatttaattctaaagatgagacttcgatttgatttttaccacattatggtcaagctcaattgtatgcttggtttttaaattaactgtatgatttgaaagatctgaggtgcttttttttcaacttgagtggatctcacatctgaatagaaaattgatcaaattctgtgtatgggtcgggtgcagtggctcacacctgtaatcccagcactttgggaggccaaggcgggtggatcacttgaggccaggagttcaggaccagcctggccaacatggtgaaaccccgtctctactaaaaatacaaaaattcgccgggcgtggtggcgcatgcctgtcatcccagctactcaggaggctgaggcacgagaattgcttgaacctggaaggcggaggttgcagtgagccaagattgcgccactataccccagcatgggccacagtgagactcggtctcaaaaaatttttttaaaaaaatctgtgtatggacatagcattttgtatttctataaacaattttttcataattactattttgttaaaatgaaatattctttagctatttattgtgtacctatcatgtataatacagcgtaggaagtcctatacagatgaccgtgatgaagaaggcttgtaccaaccttcaaggaatgtacaatttattaaaggggtatggatataaggtgtgaacataaataactacagtaattcaaagaggtttctagtaagtgcagtgagagatacagatttcaaaggggagaaaggtttctacttacaagaagaggcacaagggcattctagttggaagaaataacatgaataaaagttcagaaaggaaaatgcagaaactatacacattctccggaatgacaatgaataactaggagtaaaatttggatgaagcacaaagttcatatagcatagtattatattaagatcaaagttggccgggcacggtgactcatgcctgtaatcccagcactttgggcagctgaggtgggtggatcacctgaggtcaggagtttaagaccaacctggccaacatggcaaaaccccatctctactaaaaatgcaaaaaaaattagccgggcatggtggtgtgcgcctgtaatcgcagctactcagaggctgaggcaagagaatcacttgaacccgggaggtggaggttacagtgagccgagatcgcgccactgcactccagcctgggtgacagagtgggactccattccaaaaataaaaaaagatcagtctggggagatagttttgaacttagatgcagattgttgaatccttgaaaacaaggctggggagtttgggcttaattttcatttggaagacattggggaagccattgatgttttgagtagaatcaagggtgctgaaggaagatcactttggaggagtatacaggatgagttgtagctgcatgagacacataggctggttaaggctattgtagtggttaagacttacttaataatgccctgggctgaggtggtggggtggtatcacatcatatttaagagcatgggcttcagaatcaaagggctccatttccaacctgatcctggcctcagtagattactgaaactaattctgtcctctgtaaaaaggtaataattgtagcacctatctctttgggttgccataagatttagatcaggcaataatgtctaaaaccctcagactggcatagagtaagtactcgataaatcgttaacatcataaaacgtttgaaatattgaatgttttacgtaagaagaaagtcagagataactacaaatttgagcctcagtattagggaaatggcatcataaaagagactttccccctaaatttcatggggaaagcacatgattccagttttatgaagataatttttgatgtgcaggagttctggctaggtgtaaatccacaacaggttgttaaaactagagaagtagccaggcacggtggcttacgcctataatcccagcactttgggaggccgaggcgggtggatcacgaggtcaggagattgagaccatcctggctaacacagtgaaaccctgtctactaaaaaatacaaaaaaattagccaggcgtggtggcaggcgcctgtagtcccagctacttggaaggctgaggcaggagaatggcatgaacccgggaggcggagcttgcagtgagccaagattgtgccactgcactccagcctggacaacagagccagactccgtctcaaaaaaaaaaaaaaaaaaaaaaactaaagaagtcaatccaaggtatgcactggtttcctatagaggtgaaatatttaagtttaaagtatctgatgaacttcaaaagtatatgtatgctttgttaataaactgataattacaggattttaaaaccttcacatttcttttctaattttatcctcatttgactaagatactagattgcagaatccacacactgtaccttttttgtttactgttatatctacaatacctagtagtacagtgtgggtgaagaaggttgtcagcaaatgaatatttatatatttcagtgaatgaatattatatccttgctttgtaagtaataacttgcacacattacttaagttgttaagggagacttggctttgagtctcttgatgcctagctttcagcaacaagttgagaggtgacaatttataaagcactaaatgttagcgtaatttgaatatggcgatgccattttcttttccttttttttttttttttttaacatagtctcgcagctggagtgcagtggcacaatcttggctcactgcaacctccgcctcctgggttcaagcaattctcctgtctcagcctcccaagtagctgagagtagctggggctacagactcacgccatgatgcctgactaatttttgtatttttagtagagacgaggtttcaccatattggtcaggctggtctcgaactcctgaccccaggtgatccatccacctctgcctcccaaagtgctgggattacaggcatgagccaccgtgcctggccagcgatgccattttctagagaactattttaaatatatcaagtttatataacaaaattggaaaatgacggttgtggagactaaaatgcaaatcaagttagtacatggaaaagtaattattgagctcatatggattttcataaatgataagaatatttcttactgtcttcttttttttcataggggcattactctagtgtgccttaaatgtgatttcctagctgattcttccggcttagatcgtatggctaaacacttaagtcaacgtaaaactcatacttgccaagttataatagagaatggtacgtatatataattgtgtttctttgattttctgatatttatttcagtacttttgatcggacaccatatggacccatgtattaaattgatagtctcactcttcatatatgctattgtaaatgtaaaactcttttgatttcagtttccaaaagtacctcaacttctgaacccactactgggtaagtttaattttccttcagtgcattttgctttgatggactttagcactgttgtattttttaatgaatcattaatattaatataaatgaaaaatattaaagtttttttttttttttcttaaagctgctcattgaaatagattcctgctccatggagttcatgcaacctggtgcaagacaagttggaagttcctaagttcaaagttctgaagtattttctcacacaaagggcagttaaacagccaagtttatgacactagctctcattattcagctcttttcagctttcagatgccactacattgttattccaccttatctttgcgtcaggttaacatatcttaacatatttttttctccagttggctctctccaaaaatgccttttgtttttctctgctatacttgacttgccttcagaatattacattccagataatatgactgttcatctttttctgtctgttttgtctgctttcttaatttcttataagtcttacatgtttaggtcagataaccattttttcttcattccttgttcattactgttctatttttcatatttttcaaatgaagaagcaacacataagtttcaaaaaatatccagggtactcctggacagtgtccccttttgatggacacaactgatacctgttctttctttccaagaaatgtgaattatttgactgtgagacgtcctctagtttgtggccttcagaaatcagatcttggggagagtcccttcctacctgactgacctcccataaggctgatgctgatttggccagagatgacctcaaggcccaccaaatagagcacaacttcccattgggagctttggcttttgatcttaagcttatgggtcgattctaaccaagaaaagtccatgagatcagtgcttcaacatccaggttgacgtttaaccattttggctgctgctctttaattttcctctagcaggcatgcagtccaaggaatatcaaaattctgattgtatgggaaccaaggttactttcttgttcttggataaagaaaatttctacaattacagttcccaaagacacagttgttcatgttatttaaagttttatccagtattctaggaattttcagcaatactaatattctcatttttaaacattttttacattttattttgttttattttggtagcttggttttatattgtttttagatcagtgcttcaacatccaggctgacgtttagccattttggctgctgttctttaatcttcctctagcaggcatgcagtccaaggaatatcaaaattctggttgtattgggaaccaaggttactttcttgtttttggaaaaacaaaatttctacaattacagttcccaaagtcagttattcatgttttcatttaaagttttatccaatattctaggaattttcagcaatactgatattcactttattttttttctttttttaagacagagtcttgctctgtcacccaggctggagtgcagtggcgcgatcttggctcactgcaagctccgcctcctgggttcacgccattctcctgcctcagtctcccaagtacctgggatgacaggcgcctgccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccactgcacccgaccgatactcacatttttaaactttttttttaattttattttggtagctaggttttatattgttcttaaatttattttactctattttatttttccatcacttctttgtcccagattcatgaaatttgctgatgtccattttatgtctacttttgaactcttctctttgtgtttgttttgttcttattacaaactccaagacatttcttagaattgtctacagatttcgtgtagctacttattggtagcttcttaatttcatacttgtccagaccattagacattattacatgctctgtcttgggcctatcattaacattagcttagggattctgatttcaaagacataaagaattggcaaaactcttcttacagaacttaaaacaagttttaaagttacatttctatacatctaatacataataccttcttagccattaatgtaattcctctggataaagataatatattcaaaaaatattgggaccaaaaaatgcacttgtttcttgctcatatatatatagatgtatattttttttaatttcttgtttgtttattttggttacattgaatacagatttgctgaacagttttgatgttatttttttaataaaatttgtattgttaaagtgccttggaaatttctaataaataacttcatataaa

SEQ ID NO: 5874 - DNA, 53690 bp, human
tctccgggggagtcgctgttgctgaggctgtcgcctgaggtttttcgcgctcctccctttcctcctcctctttctcctcctccttatccgaaccccagtcagaccgatctgctctgctctcggtaagcggcccccgcccccgcctgtgccgcgcggaaggaggcagcagctctcccgcgcggccgaggcagccttccccagagggcggttctgagggcggctggctgagggtctctatgccggtgcggatcgacgggggtgcgggggaggggacaggcttggcggcgtggtagctggtgggccaccatcttgcgccgggccctgaagggggagggttttctggaggtagagcctggcggcccgcggcgggcagtggtttcgcgggccgcggcagctgcggcagccttctcacctcctgagtcctgtcggtctgtttccaacccggtttgggcttttcattctggaggcaactccctttcgtcttttgtacggttgatactgatgtttgacggagacccgcccaccctcaagtctcttcaatcaaacgaaaagagacttgaggggattccgaactttcaggcatcagagaccctgtgaccccttctttctgcgcaggttccccccacacaggaccggtcattccatgcccacaaccttgttctggccaaagggacttcccttctctgtcacagaaatcgtgctctattccgttattgtctagaggataagagccctgaggagaaacgtggagttaaatacactatattctaactaggaggtttgcaggttttacttaaagagatggaaaaaattatgctgaggtatactcctgctctagagatggagggagttcctttcaacttctctcaggttttaatgcttttttaaggagaaattcgagaggaaattgtcaagtgaaccagcttctgcaagcacgggagaccttcatccaggggattctctttgtttggaaagatttgttagttttgtggagttttttaaatctgcgaccttaaattttttttactattgttttcaggtttggactatgagttgtaatgtcttttagtgcccctaaacataaaatagaaacctagaagtagagttttaaactgcaaaagtctcctcttagtatttgtgaggtgtcctggtttgggggttactgtgcaaacttaatctccttacgcagaaacttcactgagcctacaaaggcactgatttgcttgtaaaattagggctgtgtacctttgatgtttctacagcagtacagattccattataatcgtatcttgcatttgtatatttcattggtagcaccccttttgagatgggctgtagggtgtcgttagaactgtttgaagatgaggaaacagcctcaaggacagaactttaccgaggtcatgtgcctaggaagtgatggaaccaattcttaaacctaggctttctgaccctcatccaatgttcaatttggtatattatgtctcactttttgtgagagtgaggtggtcacggagaataagcaaggaggctcacttaaaagttttaagaagtattattcaattcctttttcctttatatttttatttttaaggcttcattttttttcgactttttcatactttaatattatttctaagcatgttgaagagttgaagaatatcctattgaaaaagttcttaggttgaataactccaaatctcagctacttggttttcagtgagtttgtcttaagtagtgattcaaaaagatttgatttcctcagtaattttttttttttttttttgagacggagtctcgcaatgtcgcccgggctggagtgcagtggcgcgatctcagctcactgcaacctctgcctcccgggttcaaccgattctgctacctcagcctcctaagcagctggggttacaggcccttgccaccacgcccggctaatttttgtaattttagtagagatggggtttcactatgttggccaggctggtctggaacgcctgacctcgtgatccacccacctcggcctcccaaagtgctgggattacaggagtgagcctccatgcccagccttcctcagtaatttgaatcaaatatatacgtctagactttttttcccagtgctctgtacattcagagaaacatcactagtaatgaactgtagaaatgactcctgaaagtagagtattcgtctagactttattcatttgctgcaaagtagttttcttttaaggagttttttttttcatttttttgtttcctttttaactttttattggcaaatgataattgtgcgtatttatggggtacaatgtgatgttttgatatgtatacattattgaaagaggctaacatagccatcaccttaccaatttatcattttgttatgagaatgttagaaattattttagcaattttgaaatatacaatacattattagtattagctgtggtcaccttgtagtgcaatagataactaaaacttattcctcccatctaattaaacttcgtactcttggatcaacatcttttccccatctgtcccacccctgaactcccaagtctctggtaaccatctttctactctctgtttctatgagataaagttgtttagattccacatgtgagatcatacagcatttttccccagagaataagagaatccagctgctttttattaagataaatattaaagacatttgcaaaaatgtaaatcaatattacttttctcattaaatttgttttttaaaagttattctcattaaaagtatttttattaacttgtaatgggcttataaatattttaaataaaaacatttgaaatctgtctcagtttcaatttctaatatgggaaatatcaacacatattgtccatataaacataaagctcattggggttctcattaagttttaagtgaaaagaaatcctgggataaaagagtttgagaactactgatgtgatgcagtttatttatgatatgattttaattgagctcttcatgtgaactagatttgttttctttaagtgcttgtattcatcaacttaacggtatgacttcaggtaaggaaggagaagttgagaaaaatagtgcaaagtactgttgaggaatatttcacttgctttatttaatgttcacagtagtgctgcaaggaaggtattactgttttcgttttacagatagaaaaactaaggcttacagaggttgattatacttacagatttggcagccaggaagtggtagaccagaaattcccactcaggttgtcagcccctatgtccagtgttcccatcaatgcacttacttacattttccctggtggataagttttactcgtataaaaagcaaattgattaataatacatacttcttgaggttactttaggaattagtgattatagaatatcttatgaaacttacataaaatatttactatacagattggcttcaaaaggccagtaattgtacattagtcttttccccatattatatcttttacatatgaattataataaaagcgtatgcctataaagtctataccctgagtataaagtaaaacttctttgtagaagtatattttattatagtgccccatcccaaagctgacataaaatgttttaaaatataggcaaactttgcaaagtattatgctagtgagttttaaatcttagtgtaaaccagctattttctacaaatagatgaagtatgaaaattaacagagacaaaagttgaaaatgaataaggataaaataataaagttattaaatgtcttctcaaaatgtacctggacttcatgtgttcaggctttcagaaaaaaagataatttgcatagtataaaaacttggacaaagaaaatatgaagagcctctattttctttctgaattgtatgtaatttgttcccaaaacctactttgaaagtttgaatcgttgagatgccagtcaaattgtctaaggaaccaagatataatccagttttcttggatttgcgtactataccaattcttgttataagaaaaacatttcacagacacccctgaacttaaaatgtttgaaacattctcagagttcttacacaaccataaaacaaagcagtcaagtgaaactacaaaaccattgccatttgaatcagctttcatatattgaatgagtattttgctgagtcactgcctacctacttctattgagtttttcatacctactgatatatactatatatataatatattccctacttatatataaataatagcaaggttttttatttgaaccctttcagtaccttcatttctatagctaaccatatggtcattgcccttcatttagtgcaaatgcgtcatttatgtatataaggttggtcacccagagaatccccagagcaggcttatgttaatttttttagatagcaaaagttaaatagcaaaacaaaaagagaattatattgttatagagctctcttgcacaacctggaatatatctattttcctgagaggtctgttgaccctggtttgaaaaatggggtaatccattgatgaatttattagtagttttaaacacagttgccagaaacctagctcaaagtagattaaaccaaaaatgaataattattttctctcttaactgaaaagctgttgtggataatttgcttcaggcatggttagcttcaggtatttaaatggtatcatcaggaccggtcgaatgtttacctactctccctttctctactccagaatcgtacagctttgctatctttgttaggttctttctttggtactttttctccacatcactcccaagcttaaatcctaccagctgattattttttctttctttctttctttctttctttcttttctttttttttttttttttgagatggtgtctcactctgtctcccaggctggaatgcagtggtgcaatctcggctcactgcagcctccacctcccaggttcaagctattctcctgcctcagcctcctgagtagctgagattacaggcacatgctaccacgcccagctaatttttatatttttagtagagacggggtttcaccatgttggtcaggctggtctcgaactcctgactttgcaatgcacctgcctctgcctcccaaagtgctgggattacaggcataagccaccgcacctggccttattattttcttaatggcattattgagatacaattcatatagcatacaatttactcatttgaagtgtgcaattcagtggttttagtatattcacagttgtgcagctagcaccacagttaattttagaacattttcatcaccccagtaagaaaccctgtacccattaacagtcactccccatttcccaccaaccctcccaaccatatgcagcctctactctactttctgtctatggatttgacatttctagacatttggtatgaatgaaatcatacaatatgtggtctttttgactgtcttccttcacttagtataatgttctcaaggcccattagtattgtaacatgtatcagtgcttcattcctttttattaccaaatagtgttcagttgtatggatatatcacattttgtttgtccattcctgagttgatgggtatttgagttgtttccactttttggctattgtgaataatgccactgtgaacatttgtgtgcaaatttttgtgtggacatatgttttcaattgtctgtctctaggagtgtaattgctaggtcatgtgataactctgtttaactttgtgaggaactgccaaagtgttttccacagtggctgtaccatttcacattcccaccagcagtgtatgagggttccaatttctctacatccttgccaacacttgtgattatctgtcttttaattctagccatcctagtgggtgtaaagtgacatccattaactatttaaatgtttttttattgtggcaaaatacatatactatttaccattttaactatgtcaatctatttttaactttttgtagaataaactcttgtaaaacatagttgaattttagatacataaaagctgaaaccaaaaaataaataggaattataattatttatacaggcagtcttcaaaaaaatgaatgggttgtgttcagtaggtgtttcctcagtcagttactcagaattcattttttttccctcagaagaacagtgtattaaacatgggtatagtgtctccacctgaatcggtagctgaaatatggggtgttctttcctcttgtgcctattttgatgccaactctgagttgcagaacctagagaccctctggagttgctattataggagctcttaagatgcccactgcatatctttgctggatattccatttctctgacagctgacttaatcccccatacaattccttcccttgccaccaaaattctgatgtggtgactttaggggtttttgtgatagttttagaaggctgcaatccttccccaaaggaatccatgaagttgtatgtatttgtttattttaaaaactggaactaagtatggtagtattcttttgacgtgtcgtcccatagaaattccatagctgcatcatccactatagtagtcgctaaccacttgtagcttttgagcacttgaaatatggctagagtgactgaggagctggatttttattttttaattaagttgaagtagccacatgtggctagtggttacctcattggatagcacagctttggactgaagttatggctctaatggcatctaaagatttctgactttttagagcatttatgagcgtaccaattgagactctttggtggctgcattgggcctcaaaagctatctctatagccataggcagtaaatatgacttgtttatatagactacttgtacatttagtaatcattttaggatggttatgccaataaatattttatatgatcatttaattaaagtgttaagccaggcacagtgatgttcacctgtagtcccagttacttgggaggatcacttgagcccaagagttcaaggctgtggtatgcgatgatgagtcgtgcttgtgaatagccacggcactccagcctgggcaacatagtgagaccttgtctctaaaacataaaaattaaaaaaaaaaagtgttatatgaatctcataggctgtgcaattgtgactttaaaaaattctgtgctcttggtagcaatagatccttaatgttgagcaagaatggtcatgtatttatctgcgtggcatatgtattaccttaattctaatttaggaacaagcactaactatccaagtagttgagtttaaagagatttgaatagtcagacctcaaaactagggacatttactgaattacagaattcactagagactcttgtagtagaaatccaaacatttatacaagtaacttcttttggagttaaagtaatattttcccctttgctctaattccgtccaaataatttggaattagggagtttgcttttgccagttggaagataaagacaaatgtggagactgaattagctctgtatatcctactttagatttctgatgtctgatttttaccttttttgttttataacttaaatagtattttaaaagtttattctgtatgtagaatatatggtatgttcagtgcacgagaactcaggatacaaattcctgttttagaaagcaattcacattttttttgataacgtttaatgtaacagctttttgaaaagcccaaagaaccgtagacggattgtaaacttctgaaggcaaggactatggcttattcatctttgtattttccctagaacttggcatactaccctgagcacaaaaggcaatgaacagttactttataatgaattgttttactacgcaatttatccaattacttttctgttacttttcaaaaaactaaaaatatctaaatgtatgtgttttcttatagtaataatatttctgaaatgtgaagaataggaatcagttaaagattaatgtcacttagcatttcagaattcagatttactaaaacatatattacaggataattactcatttttgcataaagatcccttttgaagtttatttgtaatctgataactccgattttttcaagtagtaaatgtttaatacatttaactatatgttaaatgtattcatttggaaatgaaccaattatggaaaatgaattacctgtgtgtattaaacatatcaaactcaaaaggtgggcttttgtaggagaaaaagactaaatttatgtgcatttaatttaacaaaatccacactagtagtagacatctttattttagagggtggaaaactgagacctagcttactgtcttgtctggagtcatatggtgagtgtgctggagatcaaaattagacccaaagattttggatctcaggtttcatgtttcaatacttggtgttacttaaagtgactcataacattgattgatgtcatgtgttcgtacttaggtgaccttgcaacttcatggatgacgacaaaccttttcaaccaaaaagtaagtatttctgctgtagttgatactaataggcatggtttttgtactgtaaacctttcaaaagaaaagattagagacagaagtgggcacattttcttaaaaacaaatattatttatttatttatttttatttttttgagacagagtctcactgtgtcgcccaggctggagtgcagtggcatgatctcagctcactgcaagctccacctcctgggttcacgccattctcctgcctcagcctcctgagtagctgggattacaggcgcccaccaccacacccagctaattttttgtattttcagtagagacggggttttactgtgttagccaggatggtctcaatctcctgacttcgtgatccacccgcctcagcctcccaaagtgctgggattacaggcgtgagccaccgcacctggcctgtttatttttaagacagattctcactctgtcacctaagctggagtgcagtggcgtgatctcggctcacagcaagctccgctgcccaggttcaagcaattctcatgcctcagcctcccaagtagcttggattacaggcacccgccaccatgcctggctaatttttgtatttttagtagagatggggtttcaccatgttggccagagtggtctcgaactgacctcaagtgatccacccacatcggcctcccaaagtgctgggattacaggcgtgagccactgtgcctggccaaaacaaatatttattaaagtaatacatattcctagtttaaaaaaaaatacagtaaacatgtcagtaatagatatgaaatgtttccttctcatccccagcgataactactgttgtaggtttagtatacataatcacaaacttttttctgtgcatagacaaaaaataatttctaaataagatcatactatatatgttattatgtgccttttaaaattttttgctcggtagcatatcttgaaattaacaatgacagtactcagtttaaaagaatggggaagacctatttatttgttcccataatatcacagtggtgtcaacatgaatgtaaattactttttcaatcatcagtatatatgagtctcccttgtttctttaaatctggcattgcctggctttacctagtttcttaccccatagataatcatgtgttaagtacctactacatatccaatacactactgtgtgtaggaggaaatacaaagaaagaaaatatgtttttcactctcaaggagcttactttggagttgaacatgtataattaaggcacactaagaaataggcagtttgagatcatatatattaaatcttgaattgcatagcatagactgtcagtgcagtaagaggttaaagaaaaacaaatctaatggtttgctgaggaagttataattgaactaagagttggaaaggggcaaagaatcaatttggggggatatctgtttgaagttagatacttattaatatggcattttcctgaatctctgttaccacttctattaggtagatattgtgctcatgttagaggtgagaaaatagattcaagtaatttctccagagtcacataattaaaaatggtgcagtgaggatttgaactattcaatttgatgtcaagtgcatgctctttccactatactcgaatgatgtggacagtataaggtaaggagaaagggtattccaggtggaagaagcagtacgaatgaggacttcaaaggacacaatgagtgcggtattttcaagtattcagaatatacaaatactgaaatatgaattaatacttttaattgtctgacttacaacattctatgtaatgttttttgaggtatttggaaaaaagggtcagttcataatattggttacatttgggagaatttgaagattttttgttttgggggtttctttgtttggtaggcagactactgaacatcaaacaatgttatgccaagccatgatatctggcatatctgtatagaagaggaaatcaaaatgttttaaaagaatggaaccaatttgttaagaggttttgtttgtgtactgtcctcaaatcattgttttcaagttttacatgttaaggccatgctaaaggatggccttaattttgagtcaaaagtagaaatggcattattttaatatagtaaaattactgttaggaatgactgcatttgaaaaacaaagatatcattgtctaagccagaaccctgaagaagttttattttgtttttatttattcttatagttgtccccgacaatccacatgtcactccaccacttatatacattcccatttttattatttattatttattttttatttttttgagacagagtctagcactgtggcccagactggagagcagtggtgccatctctgctcactgcaacctctgccactcaggatcaagtgattctcctgcctcagcatcccaagtagctgggattgcaggtgtgccccaccactcccagctaatttttgtaatttttgtaattttagtagagacgagatttcaccatgttggccaggctggtctcgaactcctggcctcatctcagtctaccaaagtgctgggattaaaggcgtgagccactgtgcccagaccccattgctgttacattagtttacatctccttcactattttttaacctaaacaatacacttatctttttttaaagtcaaacaacttgaaaagcctttaagttacttaagcacagtctcttgaagggagggagtgaaggagagagagagaggtagagataggtgtgtatgtgtgagcacatgcaggtacctatatactccctgttttttcaagctaaaaaactgaaagcatgtactttcagttgtatagctgtttttctaataattccacgtttctcaatttttaaaactcatatgtacatatgttgtctcttgaatcatcaagttttgccattacctagtgattttctgtcaaggaagatgaggattttggttttcttaaagctttttcttccttttaagcatctctcaatatagttatatctgaatttttcagtaaatcatattcagtgattttatgatgaccgtaatactgttcacgggtgagcatggtactgtattaatgtattatgatggatacatttccttttctctttttctatgtattgtccaattaaaattttcattttataagtcagcaaagtttattaaaacctatagccactcacacccttccagagcctttttttttttttttttttttgagacagagtctcgctcttgcccaggctggagtgcagtggcgtgatctcggctcactgcaagctctgcctcccaggatcataccattctcctgcctcagcctcccgagtagctgggactacaggcacctgctaccatgcctggctaatttttttgtgtttttagtagagacggggtttcaccatgttagccaggatggtctcgatctcctgaccccgtgatctgcctgcctcggcctccgaaagtgctgggattacaggtgtgagccaccgcgcctggccctctttcttttattttattttctgagacagtctcacgctgttaaccaggctggagtgcagtggcgtgatctcaactcactgcacctttacctcccgggttccagcaattctcctgcctcagcctcccgcctagctgggattaaaggtgtgcgccaccatgcactgcaaatttttgtatttttgttttcagtagagacaggattttgccgtatggaccacactggtctcacactcctgacctcaagtgatctgcccacctcagcctcccaaagtgctgggattaaggtcgtgagctaccgcgcccccccacttctttgtcccctttttttcttgagatggagtctcccagtcgcccagactggagtgcagtggcgcagtcttggctcactgcacttcccactcccgggttccagcgattctcatgcctctgcctctgcctcccgtgtagctgggaatacaggcgtgcaccaccaccgcgcccggccccatggcctcttaattcacttttcctgcactgaaacttgtcaggtaatctaacaatttaatgtttaatattttaataatatttagggggattggcaccttcctgggagtggtattctcctgcacagctcttgtcctgggactttcttttgtttttgtattgtgctcaatgtcagattttctgcatcctgtgccattctccttcttaagtcttgttttggtggattcctactaagaaagggggaatgagagggaaatgttgtataatattgctggtctttattcttattcttatttttttttggagataagcccttactctgttgcctagattggagtgcagtggcaccttcatggctcactgcagccccacctcctggagctcaggtgattctcccacctcagctttctgagtaactaggacttgagtgcacaccaccatgcctgactaagctgttctttattcttgtttgtttgtttgagtgagactctccatcacccaggctagattgcagtggcagggtcctatctcagctcactgcaaccaccggctcctgggttgaggcgattcttgtgcctctgcctcccaagcagctagaattacaggtgcgcaccaccatgcccagctaatctttgtatttttagtagggacagcgtctcaccatgttgtccatgctggtctcgaactcctggcctcaagtgatccacctgccttggcctccgaaagtgctgggattacaggcctgggccaccacactcagccacctggcaatttctgatattctgaaatttcatatgtcccgctagtgtagtttttattcttgatcattgtgctggctgttagtgggccctttctttctgtagatttatatccatgagaactaggaattttttttgtattttcctttgattacttctcctctcctttttctctctcttttttttttttctggagcttttgttaggtgcattttatacctttgaaaatgatttttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgacagagcgagactccgtctcaaaaaaaaaaaaaaaaagaaaaaaaaagaaaatgatttttctaccaatcttgttttctgtgtttaatatatgtgttttttgtcttttggtttcacatttactcaactttgacatttgacttttttttttttttaactgaattttggctgtctttatataatatcgttgtcttatctgtctaaagatgtttattatatcctattattgtctcttgctctgtattatctgtgtcttctttttttaacttttattttaagttcagggatacatgtgcaggtttgttatgggtacactcatgtcttgggggtttgttgtataggttatttcatcactcaggtattaagcctagtactcatgagttatttttcctgatcctctccctcctcccaccctccaccctcaagtaggccctcagcatctgttgttcacctctatatgtccatgtgttctcatcatttagctcccacttataagtgataacatgtggtattaggttttctgttcctgcattagtttgctaaggataatggtctccagctccatccatgttcctgcaaaggacatgaccttgctcttttttatggctgcaaagttctccatggtgtatatgtaccacattttcttcatccagtctaccattgatgggcatttgggtcgattccatgtctttgctcctgtgaatagtgctgcagtgaacatatgtatacatgtgtctttatgatagaagagtttacattcctttgggtatatacctagtaatagaattgctgggtctaatggtagttctgtttttagctctttgaggaatcaccacactgtcttccacagtggttgaactaatttacactcccaccaacagtgtataaatgttcctttttctctgcaacctccccagcatctgttatttttttgacttttgaatagccattctgacaggtgagagattatatctcagtgtggttttgatttgcatttctctaatgatcagtgatgttgtgctttttttcatatgcttgttgcctgcatgtatgtcttcttctgataagcatctgttcacatccactgccaacttttcaatggggttgtttgcttttttcttgtaaatttgtttaagttctttatatatgctggatattagccctttgtcagatgcatgatttgcaaaatttttctcctgtctgtaggttgtctgtttactctgtctctagtttcttttgctctgtctatagtttcatttaattagagcccatttgtcaattttggctcttgttgtaattgcctttgacgtctttgtcatgaagtctttggccattcctatgtccagaatggtattggctaggttgtcttccagggtttttatagttttgggttttacattgaagtctttgatccatcttgagttgatttttgtgtatggtgtaaggaaggggtccagtttcagtctcttgcatatggctagccagttatcctggcaccatttattgaatagggagtcctttccccattgtgtgtttttgtcagctttgtcgaacgtcagatggctgtaggtgtgtggccttatttctgggctctctattctgttccattggtttatatatgtgtttttgtaccaggaccatgttgttttggttattgtagccctgtaccatttgaaggcaggtagcatgatgccttcatctttgttctttgtgcttaggtttgtcttggctatccaggccttttttggttccatatgaatttgaaaatagctttttcttgttctgtgaagaatgtcattggtagtttgataggcatatcattgaatttataaattgctttgggcagtatgccattttaacaatactgattcatccaattcatgagcgtagaatgtttttccatgtgtttgtgtcatctctgatttctttcagcagtgttttgtaattcacattgaagagatctttaacctccctggttagctctattcctaggtattttattctttttgtagctgttgtgaataagattgtgttcctgatttggcacttggcttgactgttgttggtgtataggaatgccggtgatttttgtacgttgatttgtatcctgagactttgctgaagttgtttatcagcttaaggcacttttgggcagagactatggggttttctagatattggctcatgctgtctgcaaacagggatagtttgacttcctgtcttcctatgtggatgccgtctatttctttctcttgcctgattgctctagtcaagacttccaatactgtgttgaataggaacggtgagagagagcatccttgtcttgtgctggttttccaggggaatgcttccagcttgtgcccattctgtatgatgttgcctgtgggtttgtcatagatggcccttattattttgaggtatgttcctttaatacctagtttattgagaatttttttttttttgagacggagtctcactctgtcaccaggctggagtgcagtggcacgatcttggctcactgcaacctccgcctcctgggttcaagccattctcctgcctcagcctcccaagtagctgggactgcagacacgcgccaccacacccagttaatttttttatttttagtagagacagggtttcaccatattggccaggatggtcttgatctcttgacctcgtgatccgcccacctcggcctcccagaatgctgggattacaggcctgagccaccacacctgaccgtttattgagtatttttaacacgaaggggtgttgaattttattgatagcctttactgcgtgtattgagataatcagatagtttttgtccttagttctgtttatgtgatgaatcacatttattgatttgcatgtgttgaacgaaccctgcatcccagggataaagcctgcaggatagtagtagataagctttttgatgtgctgctgtattcggtttgccaatattttgttgaggatttttgcatccatgttcatcaaagatgttggcatgaaagctttttggttttttgatttttggttttttcgttttttgtttttcattttttctgagatagcgtctcattctgccacccaggctgtagtgcagtggcacgatctcagctcactgcaacctccacctcctgggttcaagcgattcccctgccccagcctcccaaatagttgggcttacaggtgtgcgccatcatgcctgggtaatttttgtgtttttagtagagacggggtttcgccatgttggccaggctggtcttaaactcttgacatcaagtgatccgcccaccccggcctcccagagtgctgggattaaggtcgtgagcctctacgcctggctccttctgtcacctctgtttttgtttttgtttttttttttttttcagacgaagtctggcgctgcctcccaggctggagtgcagtgtttcgatctcagttcactgcacttccccttccgggttccagagattctcgttctctcctgggttccagagattctcattctttagcctcctgggtagctggaactacaggcatgcaccactaccgcgcccggccccatggcctcttaattcacttttgttacactgtgaaacttgtcaggttatctaacaatttaatgcttaatactttggaagattggctggtctcctggaaatgatattctcctgcgctactctggctgtttgctctgtagacctactgcacagctgttgtcctgggattttcttttgtttttgtattgtgccgaatgtcagattttctgcatcctgcattgtcctccttcttaagtctcgttttggtggattcttcctgagaaagaaagggtgaatgagagggaaatgttgtataatattgctggtctttttttttttttttttttttttttgagacaggtccttactgcgtttgcctagactaaaatacagtggtgccatcatggctcactgcatccccagtctcctggggctcaggtgattctcccacctcagcattctgagtagctgggaaagaagtacttgccatcatgcctggctaagctgttctttattattattattattattttatttttttgagacagtcttactctgtcgcacaggctggagtacagtggtgtgatctcaccttattgcaacctctgcctcttgggttcaagtgaatcttctgcctctgactcccaagtagctggaattacaggctttcaccatcaccctggctaattttgtattttagtagagatgggggtttcaccatgttacctatccaggccggtctcgaactcctggcctcaagttaaccacccacctccgccttccaaaatgttggaattactggtgtgagccaccgcatccagcaaagttttatttttttgttgtgtctcttccaggttttgttatcaggacaatgctggcctcatagaatgagttaggaaggactttcggtaggaatagtaccagctcttctttgtacatcttgtagaattcaagtgtgaatccatctggttctcacctttttttgattggtaggctctttttactggttcaatttcagagctcgttattattctattcagggcttcagtttatttctggttcagtctggggagagtgaatgtgtcccaaaatttattcattttttctggattttctagttggtgtgcatagaggtgttcataatattgtctgatgtttatttgtatttttctgggttcagttgttgtatctcctttgttgtttcttattgtgtttatttggatcttctctcttctgtattagtctagctagtggcctattttattaattttttcaaaaaacaactccctgattcactgatcttttgaatggtttttcttgtctcaatctccttcagttcagctctgattttggacatttcttgtcttctctcttagctttggaattggtttgctcttggttctctagttctttttgttgtcatggtaggatgttaaattgagatctgtctttttgatgtgggtgtttagtggtctctttacataatcccatatttctcagaagtcttgtttgttccttttcattcttttttctctatatttttttggctatcttagaaaaccagtcttcaagttctgagattctttcctccgcttgttctattccgctattaatacttatgattgcattttgaaattcttgtatgtttttcagctctatcaggtcagttacgttcttttctatactggctattttgtctatcagctcctgtattgttttactatgattcttagcttccttggattaggtttcagtgtactcctgcatctcagtgacctttattcctgttcatatcctgaattcttttttctgtcctttcagccatctcagcccccttcggaacccttgttggagagtgaatgcagtttggaggaaagaaggcactctggctttttgagttgtcagagttcttttgctggttctttctcttctttgtgggctgatgttccttcagtctttgaagtcactgtcctttggattatttttttcttctacctgatgaccttaagggtttgattgtggtataaggtagattcagtcaactggcttcatttctagaagattttagggggccaaggctcagcttacaactcctggagtgcatgctctaattttgtaggactgatattggacctctgcttttttctctggcttctcaaggttaggaactcactgtgctagggggactgaggtgctcgtggacctcttgtcccagcacgccaatgggtgatgccagccaaactgttttgtagggcagtgacagcagggcccattcttgttcacacatgccagtggcagcagcagcacagcagagtgcacactcatcagctgctgcagggtgctagtggcttctgcgtgggctttcgcagaagtggcagaggcagcatggctcaggggtgcaggggccccaggtggcaactgtgtgtatggtcatgctggtggtggcattagcatggggatggggcactggccgttgcaggactgtatgcactctttgtacatgttgatacaggcagagatggccgctcagggtgggggagggtccactgttctctgtgcgtagttacattctagtggcagtggtggctcaggggcagggtgctggtgggcacaggtcttgcgggctctgtgctcaccaaggctccgactacaatggtagtatggcagaggagggtgggcggagtgcactcccactggcagcaggcagggcagggtgcacatacacatatgttcttacggggcagggaaggcaagatccacttgcgcacatacgcactgactggcaaagtgatgtggagggtggccatggacccagggtaagctggagtggggagaatgagcaggtgggccagtgcatggccacaggggcaaccctgctggagctctccgctggtcaagcccggttggccagctcaggagctatgatgctggccatcagggcactctaggctgtactgcaagagggaatgggcagactggggctccaggagaggacagctgaccaaagagtgctcaggtcagatgggcaagaccaccctgcagagttcaggtctgacagttcccctagtgctacagtctcctatggaaacaagcagagcctagggggatgggcatcccaggctgtgcttgaatacagatgttcctgcaacaaaccctctgggctccactctggctcgtgtgctgcctctaccacttctctaagcagctctccctgccaactaaagtgtcagtggtgatcaaagggtcttctcctgccgggattcccagaggtccatggcaagagtgagttgttccttgccagttcaactcacccattcccccgtagtcattgggggccaggaaccaatccaggtgcacagtagccccatacaggcttcccagtttcctcccgcttcattctagcttctgtgtcttccctcagcccactcagcacctcccctttgaagatgtgttaagagtgcaccagttgtcccagtccctcggtggcagctgttccacctgtctgtatctagtttgccatcctgcctggctgtcggttttctttaaaatcctttaatctgttttattgctttggtgtttcacattgaaggttttcctcaattttctggtacgcattggttgtccacccatatttaagagtgaggcactaaaatgcttcccaggagatctgatttgggtcagaacttgtaggctggtgatattcacagtatattttttacttagtttcttcaaatgagaaatgtctaatctgtcctgaaacagaattaagtttcacttaatttccctattttcagtctagtacctcatgcctgctttgccctgtgcctgatatacctgaatctggttccgtttttctagtatatctcctatgtattttctcttattcttagtttatctcccttgtttatacaagtgaatttttttttcagataatagctacagtcttttttgtagatataatcatcctagtcctataactaaaactcactttggatttgatcctaaaatgtattggccactgtaaatgactactatccttcattatctatctgtctagccaagtttaactggtttagatcttagagatttagttctgagctcatttcttttgctaccatgtactgattacaaggcagagatggccgctcagggtgggggagggtccactgtagaccatgcctgtagtcccagctattcaggaggctgaggcacgagaatcaagtcagtaggctgggcatggtggctcatgcctgtaatcccagcactttgggaggctgaagcaggcggatcacttgaggtcaggagttcgagaccagcctggtcaacatggtgaaacccatccctacgaaaaatacaaaaattaactgggcgtagcagtgggcgcctgtagtcccagctacttgggaggctgaggcaggagaatcgtttgaacccaggaggcggaggttgcagtgagccgagatcacgcctgggcaacaaaagcaaaactctgtcacaaaaacaaacaaatatcaagtcagtaattgctattaggattattacagtgcatcttaaatatcatactatgtattgcacagaaaatatttttctctttgaaaataaagttagcttctcttctcttgaaaattagacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaagtaagcatttactttcagtgaagtaacgtttcataagatggttgtttctaatggaaaatatatgagatatctgtccttcatactgttgttcttctgtaaggagttagaggtaagagggagagtaaaggtcagtaagaacttgtgagaatcaaagcgggaatgtagttggggactggagtaaggaggtgaaaggttaaaatatcagatgtgagcaaaaggaaataactaagttaattgagggttaagatgacctgaacagcattgtaagccttctgagattggaaatcataatttttaatggaaccaagtagcctatttatttgttaatttttttttctcccttaaactcagatttacagaaaaggaagtgtttggaatacttttcttaaaatatcctgatatgctaaataagtttgtgttagtgtctgatgggggttctaatgtctaagcaactgcctcatcaaagtatcatcttgatatatgactataaaatgcataggtgctgcatgattatagaatctctggtctgtctaccagcatgtgctatagcctttggctacacccatcttccgcaactactgtttatattcatgaaggagggagggcctggttttccaacactatacttggacaatgcaggcagtcagcacacgtaaatctttttggctttctagcaaaacatgtccagtacctttgtggattgttagatttctgttagagtaattagacttggcattattacaatgttaaagtgaagatactggtgatgtttattaaaataaaatatctcctccctgtaatcctagcagtttgggaggccgaagtgggtacatcacttgaggccaggagtttgagaccagcctggccaacatggtgaaaccccctctctactataaagattaaaaaattagccagtcatggtggcgcgtgcctgtagtcccagctactcaggaggctgaggcatgagaatcgcctgaacctgtaggcagaggttgcagtgagccaagatcacgtcactgcactccagtctaggcaacagagcaagactatatctcaaaaaaagaaaaaaaaaaagtcctcaaatatgtctaaagtgcaagggacaacataactgaatttcaggagagaaagagggaaacagatcctttttcattttatttacttattttaggcctggagaagtcaaggaatgtagccagcataccagtcttctttcttaccatggcaatgagtaatagtgtggttaagagatgagttttaaattttctgaaatcctagttcttacttctcttggctctaaacttggaatagcatttctactcagttttatcagaggcagaataatttagccaattgaattctcagtatcatttcctgtggcaaattgggaggttctaagtggagagccacttaaattattaaatgagctagatatatttggcatatttattattgatagtagaatagaatattctcttattatttctagtcactgtgacaatttttatgctgaaatattaccatatttcaaaattattactcaaatcatcttattgaagcatgacaagattcaagttggatttatattgattgtagatgacttagcagtactcaaccaaaacaatgtgtattcgtttcaagagattctatcaaaaagggtattgggcccactagaatttcttttctatattgataacttagaatttaagtgattttattgatgttttatttgtgagctataaaatattttagcatatgggatctcatctaaatgtttatatagaaaaacaatgaaggcaggggaaggagagcaaaaaacttgtgattggtagactataaccaccaacaagtaaaaatagctcttagtggattgagtaatacttatcttgaatttctgaatgaaaacattatcaagttgtttgaggatatttttcttttagaagacttccgtaatgtttactcatagagtactgcatttctatgatcagaaagcaaccctactttggtgtgacccttcacttaatagaattgttttgtgagatctgattcttttctctctttttttttttttttttttttttaagatggagtctcgctctgtcgcccaggctggagtgcagtggcacgatctcggctcactgcaagctccacctcccgggttcacaccattctcctgcctcagcctcccaagtagctgggactacaggtgcctgccaccacgcccagctaatttttttgtatttttagtagagacagggtttcaccatgttagccaggatggtctcgatctcctgacctcatgatctgcccgcctcggcctcccaaagtgctgggattacaggtgtgagccaccccgcctggccgggatctggttcttttctactaggagagaaaaaaggaaaatgtttgaggttttatgggatttgttaatgctttgtgccttttcctgataaacaattttaagcaaatcactattcttccaaatttcaatttgactcctcagtaacctagaagttacggagttcatatgggtacaagggtgtgcagtcttaaaccgatccagagggttttgtgaggctcaaactgacttctagcgtagtaatagatttgaaaccccttacattaatcagatactctggaactccaggtttaatttagtctaatcagatactctggaactccaggtttaatttagtctgtagtctctgataatttcctattcagaactcaagagtaatggtacagaaagttaatccagtcagccctcccatcatgaaacttccagatttttagaggtgtgaatgtggcacagggttggggaagggtttgatttcaagtcacgggaatcagaatctgtacacaaccctgtcaccattaaaggaaagaaatatacttcaattattggttatgcaaagatatgtttttggaggaatttttctattagtatatatttcattcacataacaaattttaaaataaatataattttatagatattttgaacagaggccactccagctcatcttcaaaaggaataaagagtgagccacacagtccaggtacagtattactgtagtatttcaattttaaagttaaatattttgatataattggttgtatagaaatatattcaatatgttgtataattttaaaatacaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgtaagtgtttataaaattacacaattaattcagggacacattggctattataatactgagttaaaattgtgatctgtcagccgggcacagtggctcacgcctgtaatctttggtactttgggaggccaaggcaggcagatcgcttgagcccaggagttcgagaccagcctggccaacatggcaagaccacatctctacaaaaatacaaaaaattagctgggcatagtggtgcaccacctgtagtcccagctactcgggaggctgagatgggaggattgcttgagccctggaggtcaaggctgcagtgagccaagatcataccactgcattccagcctgggtgagagggtgagatcctgattcaagaaaaaaacaaaagccaacacaaacaaacccaaaaaattgtgaactgtcatagctagttaccatttcagtagaaaaataatccccatctttatgatataactcaaccaaaacccaaaataataactgcaggaattgtccaacatattaataaatcagctaatatgcttaaatacagtattgaaaactatactatctaaatatgagtgaaaaagtatgatcaggttgggcatagtggcttacacctgtaatcctagcactttgggaggctgaaggaggtggactgcttgagctcagtagttcgagaccagcctgagcaacatggtgaaaccctgtctctatttaataaaaaaaataaaggctgggcgcaatggctcatgcctgtaatcccagcactttgggaggccgaggtgggtggatcacctgaggtcaggagttcaagaccagtctggcaaacgtggtgaaaccccgtctctactaaaaataaaaaaaaattagccaggcgtgttggcgcatgcctgtagtcccagctgtttgggagtctgaggcaggagaattgcttaaacctgggaggcagaggttgcagtgagccgagatcgcacaactgcactccaacccaggcaacagagtgagactccatctcaaaaagacaacaacaaaataaaaaactaaaatgtattgcaacatgaataatgcataatggccacatttttaagttaataaactaaaacaagtgttcttaaattggaaagagtgttctgaagtcattattgcttattctgaaatcatactttcatagtttagctttaaaaacttttaataaaagtaatagataatgataatacttaacatttactggcctgttaatatgtacaagtctttgtgctaatcttatttaattcttatggcatctttatgaggtaggcacaatttttatttttttattttatttttttttgagacggtgtcttgctctgtctcccaggtgggagtgcagtcatgtgatctcagctctctgcaacctctgcctcccaagttcaagagattctcctacctcagcctcccgagtagctggtattacaggcacgcaccaccacacccagttaatttttgtatttttagtagagacagggtttcaccatggtggccaggctagtctcgaactcctgacctcaggtgatctgccacccgcccccccccggcttcccaaagtgtggaattacagacgtgagccaccacgcccagctgagatgggcactattattattcccattttatagttgaggaaactcaggctcagagaggataaatgattcactcaaggacacacagctggtaaatgatggatctggtatttcaatccaggttaacccagaattttaaacatgtgtatacacacatccatttatacatttaagcatatactttatttatttagagacagggtcttgctctgtcacccactctggaatgtagtagcatgatcatagctcactgcagcctccaactcctgggctcaagcgatccttccacttagcctcctaagtagctgggactacaggcatgcaccaccatgcccagctaatttggcttttaattttttttagagatggggctctcactgtgttgcccaggctggtcttgaactcctggcctcaagctatcctccatctcagcctcccaaaatgttgggattacaggcgtgagccactgcactcagccccattaagtatgtactttttaaatggaagcattgccttagagcagtggtgtacccttacggttccctaagtctctttcagggatctgtgggattaaaactattgtcgtagacatttgtgctcttcactgtgttgacattgtaaaactctccaagtgactgtaatgtgcagccagagttgagaatgacagacagatattctcgaatgaattgagaatcctacataaggaaattttatttaaaaatttaaatctatttcattatctgtatctcagttctttcaggcagggaaggagagtattattattatctcttttaaagtgagtattattattatctcttttaaagatatagcttaaggacacaggctttgtaatcaggcggaccttagttctgattccagctccttcatctgtaacaggctgggttgtactgggaaccttaactacgagaaattttagtttacctatttataaaatgtgagataatattaggtctttattcatactgttatgacaactattaataaaatacatgtactgtgaaagaggcaagtacattttaaatacataattattagtggctcttatttcagttggaaaggtaaataacttgaagctcagaagtggcttgcccaaggtaacatagttaaataaatggacaggtcttctgaatctcagcctcttgcctagtctgccttactgttacatttgttatctttctgaaatattttatgagacataagaaattcccaattggagaattatttaacaggttgtttgttgaataatgtgtctgctttccgaaattgtggtacttaatttatcagagatgtcacctcagaaaaggttgaaagtgttacctttattcagaggaacttctgttaactatttttggaaattgcaaacggatattttccacttttaaacttttaaataaaaaatatttagagaaaatatttactttgtggtaagattgcacttggttacaattaagtcatagtctaaaacctaatcatctctcaaagtgtaagcacaaaacaagcaagcaaaatctttatatcctcattataaaagtattgtgtaaggagggataggttagaaaagagacagggaagaatatatactgtattttgattttcgttttctgtagatggttagggtgacattagagtatatcagtcaggggaccatattaatatatatttgatatctattcctcatttttcactgaacattgtactgggaacattgttctttgtcattgggtatttcccaaaaacatgatgttatgtgatagtatcatttaatttatttagtcatttctttattgttatacatacaggttttcaatttttgctattataaatcattcttcattaaacattttcatttctttagcatagattcttagaaattgagtaattggaataattggaccaaagaatatgaactttttttaaaaagcccttgatatagatactgctaaaatttccttgcagaaaagttgttccaaaatataacctctactttgcctgtaatattatttttaaattttaacattttatttcaaactaattttagatttacagaaaaattacaaaaataatgcagagttcccatatactcctcacccagtagatgctaattttggcagagactaataattacctttgtgttttataccatattagtaattgagttattaagattctttatagtattgacatacagctaaatttatctctataaaagtttatgaaacaaaataattataaatttttacaggattttacaaagaattcacaagttggatcggataattcttcaattttactgtttgactcgacccaggaatcactaccaccatcccaagacataccagcaatttttagagaaggtttggtttagcactctttcataaaaattataaaaagagacttgtcgaatatacatatggaattgaatttctgttttgaagcccataccttcatgttaagtttttcatatattataacatggaatagagctaatcattcctgaatgcctttcttgggtgatatagaaaattgtatttagtgatagaatgttttatttatttctattaagttggctagcacatattctttgcactctttttcacttggaaccagccatggactgaacaatcttaatataatttctgtgagtcaaggaagtcccctgatgccttaaatactctgcgaaaacaagtagtaattatttggaagacacttaatatgagaaaacgtgcatggttatagttgatttctcaatatgctaatgtctttctattcaaataaatgatgtggatatgatagttaaatatgattatagagtagtattgtaaaatgaacgaactaaagaaacagtgatttccacatggtaagtactcagtaaatatactttgaagtaataatggaaattttccaattgaagtgttacagttctttgatgtccaccataacaaagttcttcattaacctaaaatagtatgccaataaaggaattttgtctcattgaaaaattccctataatcaaagcaattactattctctatattacctagtttgatatgtttcactaaatggaaagaggaacacaatttttttgcatatgtaattatttactcataaattagtatataacctttaccaaaccaaaacaaaaaaattatagtcatatgaatgccaaaaatattttcccatttttatattacttggtttgatattcacctatctaggtgtcacttatctagatagtaaaatagccaagaaccgaaacaaacagggagataaaacagttgttttaactcgggttttgcaaagcacatgatctttattcatggaaaaagtctgaattcttgaagcttccaaagggtaaagacagtgactcctactctctctctaagattaatacagcagagagtgggactttgtcctgaatagtaaataggattatagttgattgggaaggtacaggtttaagcctttattctaaagatttttgtggcttttatcaagtcatctaacctctttatacctcagttttctcacattattaaaatactttcatttttctcacataaagcatttattctccagacctgaaatgagccagccatttggatattcaattttaattcttgctctctttatctcagggcttctttgaggcccaaataaaataagtggaaagtgaaaaatgcattatcaattttaaaggatttgacaataaacagttgttagaatgataatcatgcatgataatatgtgctatatgttcagaagcatgattaatggactcctgtctaagatgatcatggagagttcttagagaaagttggatttgaacttgattttgaagaatgaggataggatttttattagcacagataagaagagttgaggtagggaacaccgcaagccaaacacaacacaaataagtaagctaaagggtcagaatttaaaactattgagctcaggttgattttatttaacttagattcatcatgcttaaaataagcatatattaaaacagtctattatccagctggttatataatcagttgcctagtccaaagtactagcactcattggttgttaaagtaacctaagcatctcagaaaaaatgttagtgattacacaaaaattagtcttaggtgccttcaatatagctggcagtaattatgtgctttgaggatggaaaaaatcatttctgtttaaggaaaaaatcatttttatctcaaagaatgaaacacagatttaacagaggaacccattaatgtaatacttactttcctggcatatatctactctactgcttctcctattaatgtacagttgtgagcttttaaaacacgacatgcagttttagaacccttatcacaaagtacaatcgtatattattttcaaaaatcacttttgctgggtctggttatagcctaaatagccccacatgtcttgggaatgccctgaattatataatcctttggtctttaaggtggtggctctcaaactcagaactatctttagcaatgaaattcttactcagataaaatttatgcagaaattaataaaacataaaagcagagtttctttatctgacatacccattacattttctaagatagacccattggattaaggggaacatactttgaaagtcattatactaactctaaaccttttcatatgaatgagtgaggtattatcattcaacattagttgtttctactttgtatatagggagtaaacaagataatttaaaccacctgttagtttgttcggtggaaaaagaaccaacttgaattttccattacacatcttaagttttttaaaaaacattaaaaatgtttctctaaacgtttggaataaattttttaaatattttacaaactcaaatgtatttaagcatctaaatataagttgatgtgtagaaacttagagtattccctgtgctataacttttatttattttatttagcttggaattttttggtctaacttttttcatgatacctgtttgttttctttatttgaaagcatttttagaatttgggtatataaagtttattttgtgaagtaaagatatgtagttcatagtagtagctgtttgtgcaatttctgcttgctcatataaattttaatcattctttattgtcatttgtatgatatgcttattaaattatattacctttaacttagttccaaactgtttttgctcagttttaaatgtaaagccattttggtagcagttttacataagcaatattccatactgaaatatttacaaatatctttctcactatttaaatctttgtaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtaaacatgaaatctgacatgtaaaaaaaaatagtattatttttatatacgttttagaaattgtgatgaattttaaaaccattattagtggtcatttaaggttttaaaaagatggatttgagtcttaaaagttcttaatttattgtaggtacaaatacctcatctccatatgatgctggagcagattacctaagagcttgtccaaagtgcaatgttcagttcaatcttttggatcctttgaaataccacatgaaggtaaaacttttttcaaagttcaattgttaaaaatgttttatagatccttgaaaatattgaaaattgatatacagtaaatgctggtttatccagatatttagagaagaaacctcgtattggcatttccatgtaacttaagttaaaattgatattcacaatgattatataagattttaaaatcctttccaatgatgaaatttttaaaataaagttatggatagaactggaagccattatgttaagtgaaataagccaagcatagaaagacaaatggacgttgtcactcatatgtgagagctaaaaaagttgatctcatagaggtagagagtagaacaatagttgccagaggctgggaagggtatgtgtggaggggtaggagaagaggaagagaggttggttattatgcacaaatatacagttagatagaaggaataagttgtaatgtttggtgcaaagtagagtgaaaaatagctaggagagagcacttagaatattgccaacgcagagacatggtaaatactcgaggtaatggatacctcagacatcctgatttgatcattacatattctgtgcacttaaaatatcacatgtaccccataataatttataaacattatgtatcaatttaaattttttaattaagttcatatgcagtacagtgtatgcatattgtattttatttttatttatttatttatttgagacagagtcttgctctgtcacccaggccggagtacagtggcacaatcttggctccctgcaacatttgcctctccagttcaggcgattctcctgcctcagcctcccgcgtagctgggattacacgtagcaccaccatgcctggctaatttttgtatttttagtagagacggggttttgccatgttggccagactggtctcgaactcctggcatcaagtggatccactggcctcagcctcacaaagtgccgggattacaggtgtgagccactgcgcctggcctgcattttaattttaaatgaaaataatgtacaaattgcaatattttattgactaaattatgacattcttcaaacttcctgtaaagcaggtgttttattaggtgcttaatcttttgtgtaaagtgaaagctccttttgtttaccttattttttgcccatggtgacatatccatgtcgcattaccctgtgaaaaccttatttttgcccgtggtgacttaatgcatgtcacattaccctatgaaaaccttagtcttacattttaattttcaacactcagaaataaacttctaatgatggagcatttcatatgaaatgatagttttaactcaatccataatatagtttatatagttataaatgaattctagctttctattaatataggaagctctttgaaattaggttttaggtaattttcacagtactaatagagtatgggattaaggtaacacgccacttaaaatattttagtagatattacagtattctgttatgtgtgtataaagatagtctgtattctctttgcatgcccagtgtaaatgacaggaaggggcaaaggaggcaagaaaaaagtcagtgttgattatatgtgggaaataagtgatgagacgagtgcaaagcaaagaagcaacttaggaaaaggaattgttcactatttcaaagattggcaaatttttattaaaattcagcattttacaaaaaaggaattctaaaattgcaaatacaaacgtctttactctgacgcaaaactgtattagagtctttggctgttttcacctccctgagtgtgtttgggaaaggggaatccaagtctcacattaccactgtttcccttgatatcttccaattctgtttcatggtgttgctctttaggacatagatgtatccatctcttacgattcattgtgggtgcaccctttagcatttttatagtgtcctttttgtctgttcagtgctttttgtttgatatcaggctcacaacccttgctttcttattgtttccacctgcctgttatattctttgcttatccttttactttcaaccctcccaaatcactttgtttttgttctttcttgctttcaccagagttttttcttttgtgatcctatatgaaaacttcttttcttttagaagttgagttaaacccatgtatattcattggtaggagaaatttaactggtctgataggtttaattggtcttagttttgtcacaatgctttgttatgctttctttgtccttttttttttaaaaaaagtctttcactttgtgattttaggaaagtttttcttttgttttccacccttgttttagtgtgtagtcttgtctttatttaacgctttatttagtatttatttagtatgtagtcttgtctttatttaacactttattgaggtatgattgacctataaaaatctgtatttaatgtatacagcttgatgagtttggagctaagtatacatccatgaaaacattacaatttgtgtcataaacataaccatcaccttcaaaagtttcctcctaccctctttattattattacctttttgtgatatgaacacaatagaaaatctatgcttttagcaaatcttttttttttttttttttttgagacagagtttcactcttgttgcccaggctagagtgcaatggtgtaatctcggctgaccacaaccgcaacctccacctcccgggttcaagcaattctcctgcctcagctttctgagtaaccgggattacaggcatgcaccaccacacccagctaatttcgtatttttagtagagatggggtttctccatgttggtcaggctggtctcgaactcccaacctcaggtgatccgcccaccttggcctcccaaagtgctgggattacaggcgtgagccactgcacctggccaaatttttttaagtatgtaatacagtattgttaactatatatgcactattctatatagtagatctctaggacttattcatcttgaataactgaacctacataccttttgactaataccttcccattttcccctccctctagcccctggcaatcacaattctactctctgcatctatgagtttgactattttagattcctcatataacagaaatcatgtaatatttgtctgtctgtgactgtcttattttctttagcatgttttccaaatccatacatgttggtgcaaataagatttctttctgtttttatggctgaataatatttcatttgtgtgtgtgtgtgtatatatatataccacatcctcctcatccatttgtatattaatagacatttagattgctttcatgtcttggctattatgaataaccctgcaatgaagtctacctacatgggagtacagatgtctcattgggattccgatttcaattcctttgggcatatatacagaagtaggattactggatcatatggtagttctatttttaactttttgagaaacctcccatgtcttccatagcgactgcaccaataacattcccatcagcagtgtaaaatggttcccgtttttccacattcttatcaacacttatcttttgtctttttgatatagctgttctaataggtgtaaagtgatagctcattgtagttttggtttgcattttcctaatggttagcaatgttgagcacctttgcacatatgtgttggctactcataagtcgtcttttgtctattcaattccttgtgcccatttttaaattagtgtatttggttttttgctattgagttgtaggaatttctcatatattttggattttaaccctttctcagatagtttctcctatttttttatccagttattcttagagaattcttctagagaaattctacaactgtaaaatatatacaataaataaattagtttcatctcattggataaaaaaggcttatatatgaaagtattccaattaggatcagtttatatgatgtcttgattttattcatgaggtagatttccccttcagatatttaggcattctagatagaatatgttgagatattcaaaatgtaactgatgcttttttgtgtcccacacattttctagcatggtaagtctggagaatggcaggttagctgtgctcaaagtctagttccaaccaggcttcacttaaatattactgtgttatttgataatcaagcttatacataatggcatgtaaaactaccttttaagcttttttttttttttgagacggagtcttgctctgtcacccgggctggagtgcagtggcgcgacctcagctcacttcaacctccgccttacgggttcaagcaattcttctgcctcagcctcctgagtagctgggactacagacacgtgccaccacgcccggctaatttttttgtatttttaatagagacggggtttcaccatattggccaggctggtctcgaactcctgacctcgtgatccgcctgcctcagcctcccaaagtgctgggattataggcatgagccaccacacccagcctaagctattttttttttaattattgtagattcaggggtacatgtgcaagtttgttaacaagggtatattgcatgatgctgaggtttggacttctactgatcctgtcacccaaatagtgaacatagtacccaataggaagtttttcagcccctgccttcctccctccctcccaacttttggagacctcagtgtagtttccatctttatgtctgtgtatacccaatgtttagcttccacttacaagcttccacttataagtgagaacataagatatttagttttttgtttctgtgttaattcatttaggataatcgcctccagctgcatccatgttgctgcaaaggacgttatttcattcttttttatggctgtgtagtattccatagtgtatgtgtaccacattttctttatccagtccactgttgatgggcacctaggttgattccatgtcttcgctattgtgaatagtgctgcaatgaacatacaagtgtaggtgtctttttggtagaacgattaattttccagtgagtatatacccagtgatgagattgctgggtcaaatggtagttccatttttagttctttgagaatctccaaactgtttctacagtggctcaactaatttacattcctaccagtggtgtataagcatgtaagctgtatcttgacacagatatgaaatgggtgattttgggccaagaaaaatattattattaaatatttacatctaaaaagaaaaattgcaaggaaaaaatattagatacataaacatcccctgatcttaaggttttcaatattgtttttgaagttattcctttattaagatagtaggtgtttattgtttgaatttttttagaatatgtaaaaatggaagccacaattttggtcagtatctttctagatacattgccaagcgtagttttatatcatctgaccttagatgtaaacacaatcattttttggtatctaatctttaaaagagctgtagacaaggctcatatttttttcctctttcagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtatgtaaatatttatttttatttctgtttgaaagttgggatatgacagataagaatatagtatctttacattgctctgccatcctcggtaattaattctaatactttctactaagaacagtggcagattatcatgttgaaaagcttttgttccttcttgtattttaagagtttgactccaggatccacctagttgttttgttttcagatagcttaagaaaagacaaaatgtattttaatttaggggaaaactacttattttccctacatttattactgaactagacggtttcatgaaaaacttatattttctagctgactttgaatcttacttttcttcatgtcacaagaagaaccctatgcagcatgacctcctccatactaaccttatttaaagctcaaatttttccattttaaaataaattgcaggcgtttaccaaaaccaaagagaagtgttttggaggtgtgaaaaaagataaaaacccaaaccttcacaatgattgctatgtaggttgatgacattatcactttgtttcaagattattttctttagtgattcataataattgtaagtagttgacccagtcttaaaactgttgtttacattgaataactttactttgaaattcagcaaaaagttttagtaagccctttgaaaatggtatgtccatttatattgtactctctgccattgaacatcatagttccttctcttcagaagcctttcagagaagctaaaatagcagaaggtaaaactgaaaaatagacagtgctacaaagggcacagcctgctaagaaaaatgaatagtttgtgctaacagtaagccagtataattagataaaacaaaaggttcttgtaattatagtcattaaaattgctattgcatgcatttagaaaccaagacacaaataaaaatataccagcagtttgtcttttgagcagctgaaaccttcagagctttcaaagatttgtctcttcactgtagctgcttttggtggtagagtttccatcctttcagtattttattttaaaatgtaaatagtatttcatgtatggaaaagaagcctgctatttttctttgctaaaaaaaattttaaatctaaaataatgatatagtgttacagcaaattagtgatgtttcatactactacattaatggattattttagaaacaaagataaaaaaaccttactgagccacttaatgaaagtaaattatttaaagtacacactttatagagtgctttcaggccttggagatgttattttgagtcatagaattacattttaaaaatttattttcagagacttatttgtgaggtttttctttggttataagtctgaatttttgctcttactggcaaattgtttgtaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctagtaagtgaaagtttctttggaatcctgaatattgttgactttgatcatccgaactgtgaggaaaccttaaaaattctggcagaaaaaaataagaagtagactttgtaatatgagggcaaaattgaaaaaaaaaatcataacttttataaacctagatgaaatgtgttctaaagccaggtgtgatggtgcatgcctatacacccagctactgaggaggctgaggcaggaggatcacttgagcccatgagttcagtactatagaatgctatgatcaattgcacctgtgaatagccactgcactccagcctgggcaacatagtaagaccctgcctctacaaaaaaaaaaaaaaaaaaaaaaagtagaagaaaaaaactgttaaaattgaagtcccttggtcgggcgcagtggctcattcctgtaatcccagcactctgggaagccgaggtgggttgatcacctgaggtcgggagttagagaccagcctgactaacatggagaaaccccatctgtactaaaaatacaaaattagccaggcaaggtggcgcacgcctgtaatcccagctacttgggagactgaggcaggagaatcacttgaacccaggaggcagaggttgcggtgagccgagatggcaccattgcactccagcctgggcaacaagagcgagactccatctcaaaaaaataaaataaaataaaataattgaaatctttcttataaacaattcattagtggaaacttccttggcacatgcattggtgtaggggactaaattagaacacccagattccatggttttcaaatttgaagttaattgtcttgatttacactttagacaaaagttaactacaatgttaagatttagagtctgagacgcggacaaatttggttcagattccaactttgcctcttactacagctgtgagatctcaagcaagtttcttaatttttctgtgcttctggttcctcatctgaaaaataggaataaaaataacagtaccttcctcagtgatgttacgagaattaaataagctaatatatccttggaacagcattacagagtcaacagctatagaattgttagaaccacatcactgttacttctactattattattacttgttgtggatgtacaaaatgaatctttttttatatacatccttaaatggtataatgtgtttttttccactttcagctatttgcaaaatctgtgaattatcatttgaaacagagcatattcttttacaacatatgaaggacacccataaacctggtgaaatgccatatgtttgccaggtacacacacattttattgtgtagttaagtgtttgtttaattttcatgtgccatgaaatagtattgttcttttgattttttaaagccatttaaataaaattagttactatgctaaaattgaagaccctcttcattagtggaaacccccttgggtttaactcatgcattgtaagtaaaggggtggagtagattttgcctgtgggttgtagtttgctgacctctgtgctagatgaggaaatgccctactagagaaagacaaatgtgtgggttatcatatagggaaaattatagatatgctagagaaataggaaaatctcttagttatagaataccaaattaaatgctttgggatcagtgttccagaatttgaagtggcttccagtaacgaggaattgagatgaagataaattgacactggcatagcatggatgctatttaaaatctaaagaagagaatactctgttttatatagcaggaaaagctttttagaacaatatttggcagaggttgaaaattcacatcaagatagggggtggtagatttgaaaagaagaagagagtcttactgtgttttggaatatatgcctaaactttgaaagatatctttcaaaggttatctttattacttgcagtaatatgattcttggttgtataggcagcagagctggactagtagtacatgttcttccaaacagatgacccgttattgctactttgattgtaattgcaagaagttataaaatatcaagttaaactaagccttctttatatttctaggtttgccagtttagatcatcaacattttctgatgtagaagctcattttagagcagcccatgaaaacactaagaacttgctatgtccattttgcctcaaagttagtaaaatggcaaccccctacatgaatcattacatgaagcatcaggtgagattaagcagttcttatttgttcatgttgtcttagtgaaaagatatagatctatatgtatagatctatagctacatctatatctatctataacgtagaacattggttagatttgttctggacagaaagcaaagttgttctgaatgacacaattaatttataatttatgctgaataacttgtgaaactttcacttattttccttgcttgctttctggtgacactgagaatcataaatagtcaaagttctgaaagatagctagaaataggaaccccaaagtggaggaaaaaacagaagattcatgaaatatttaggttagatatttcaggacctaagggtggtgggactgggaatgactttgaaggtgcttatcaagagcaggaaaaagaataagtttgaatggaggaacataagattaaggactcataaccttgtattttcctctttctcttgaaatcttatttctactttctagcccactttttattatgagacatgtggttgtcatcagtgacccagaattgacttttgtagcagccagtaacaaaggaaacagcaagaacacttatgaccagatatgtgaactatactagagaactatatttaggttataacttacttactttgtgacttttgccagttctgctatataatttctgggataccagtattgatgcttgcatctttcccttgaattctgattttatgcttactgattcttttcctcaattagagcatcctgtgggctgaaaactttgatgaaacagtgggcctattcttgagtgtttgaaacagcaatagtgcctttgccaaaatcagaagtcaacggatttactaagtctggtcatgtaatcaagttttgcctcctcactgatcagctcattacattttcgtagtattgattgcattgtctcggcaagttgattcagtactggcactaacgtcgcccttgaatgtagtcattggatgatcatgaaatcaacttatagttgttaattggaaaaaaagtcataaaaatagaatttccaaacacattcagattacctgtgttatgacttggatggtatcagtgtcttttttttttttttttatcctggtaggccatctcacccttaaaaactttggcaaaatctttctagggtttccaccaacagtgttcactcagatgttaataagtgttcccctcttaacttgttcctggtaaaagaaatttagtgaatggctggatttacaaaattcatagaggtgttttttgtttatttttaacaacaagacttttcagagcttttaatatgctaatactgtaaatctctaagcaagggacatagtgtgtaatagtcctcaaacatttttaacctttgagccctttatttgcacaatacctattaacatttcttgaggtatagagtttgggaaacactattcttggtggtctgtatttcattttttggccttcaattttgaaaagaagaatggaacataaagcagtatctctgactgtctaattatgggttttttaacataattctttcccctgtgctttactaagctccagagtgatatagatgtagatttgaagggagtgataacatgcttagaaaggtaagaaagacataatgaacccactttgtgagctgtgtcttataagtggtttatctgatctgtagtcattcttcatatcctaagttgtatgccttaacttgctgtatgtattggaaagagttacccaacaggtctgagttgctcaaatattgcacaatttcagaagtgcctgcttgtataactggcccttggctaaatcttggaaattgagcttctaaaatgttctctatgttattaactgataagagtggtttacatgcctggaaccttgagccatgttgtaccagttagtcaagaaaattcgcacaaaaaaatacggttatggtgaccacctgcttttcttgcagtgggaggagtcgtctgaaaatttggtggcttacctccataaaaaacctaagctcttagactcaagagagctttcccatcaagcaacactttatacgtgttgctgcagttcattgctgagggattttatacatgttgctgcagttcattgctgagggattaagtgtgtcctatgtgactccattggaatagagctcttagaagttggcgcctggtaatcctctagaagctatccagtacaccattttcctttattaatcctgctctgtacccttacactgtaataaaacatagctgtgagtataacactaagtcctatcgatccttctgctgaatcatcacatctgggagtagtctgagggaccactgaggtgccacaggtgctgtcttagtctgtttgagctactataacatgctattataccattgactgggaagcttaaacaacaagcacttatttctctctgttatggaggctgtaaagtccaagatcagggcaccagtggttcagtgtctggtgaggacctgcttccttgttcatagatggccatattctcactgtgtcttcacatgggggaaggggtggagagggctctctagggtcccttttataaggacactaatcccatttatgacagctccaccatcataatctaattagtttccgaaggctccacctcccaatactattacattgaaaattaggatttcgccatatgaattggggggcggaggggacacaggcattcagtccatttcaggtgctgaatttttttgttaagtttggagtacctgaagagtaaacagtcagcagtgaagaggtaagattctattgataagaaggatcatcaggcttctctgaaggtatttgcagtttgcataattattcacaaaagactcaaaaacctgagctgaccaatattataagcttataatttagatggcattagtgcaattttatgtaataagaattattgactctatggtttattttattctttttgaaaactttgattgcaactttttcctaaaaataatatattattatgtcttgagtgattttggagttagcaatgcagtttatacattttttaacaaaggacgaaagactccacatgtgttaaatatcctcattagctctttaataacaacaataagcagttaacatataataatcacttaccatttgacagccactggtgcttttacatgcattatcttgtttaatcttcacagccaccctatgaggcaggtatatgattgttttcattttatagatgaggaaacaaagctttatagaaagtaatttgcccagtgtcacattccctaacaaatggcagagcccaaaattgatttatagcccaagcttccaccgcagactcatattccacattgacattaggtctaaaggcagaaattacagatagttacccttgaaaatccctcaaattggccaggtgcagtggctcatgcctgtaatcccagcactttgggaggccaaggcaggcggatcacctgaggccaggagtttgagactagcctggccaacatggtgaaaccctgtctctactaaaaataaaaaaaattagctgggtgtggtggtgcatgcctgtaatcccagctactcgtaggctgaggggggagaatcacatgaacccgggaggcagaggttgcagtgagccaagatcatgccactccagcctgggagacagagcaagactccgtctcaaaagaaaaaaaaattcctcatataacccaaaaaccatatagtatgcatgtcaagaagttcaacacttaactttttctctacccttggaacaagttactgtttctttggttaaacattattttaaaaatgtattagttgggcacagtggctcatgcctgtaatcccagctctttgggagaccgaggagggtggatcactggaggtcaggagttcgagaccagccctgccccatctctaaaaatacaaaattagccaggtgtggtggcaggtgcctgtaatcccagctagttgggaggctgaggcaggagaactgcttgaacccaggagacggaggttgcagtgagccgaggttgtgccattgcactccagcctgggcaacaaaagcaaaactgtatctcaaaaaacaaaaaaaagtatcatctgtgatcattagcacaatgcaagcatacatacataagagggatatccaggacttgagtccaactaagggaatagtagattaatgtctcccatcttggggctctggacaagtaaatactcattgaatgaaatggcagacactttgaactagttaaattgtgcctgctgctcatttgtactctgtcagtctcttgcctcactttatttctttatttaagaaatatttgagtgcctaatatatgccaaggactgttttaggtactggggatacagaagtaagcaaagcaaggtttgtactcactgaaataatgcatcatggtagagaagggtgtgtgtgtgtgtgtgtgtgtgtgtgtgtgtgtgtgtgtgtgtgtgtgtgtgtggtgtctgaatgtatatgtatgccagctgatggtaagtaccatgggaagaaaatataggtagatagagagtgccagggctcaggtgaaggagtggtttctgttttttaaatggtgtggtcaaagagggcttctccaaagggaataagagagtaagtcatgtggcttactcatctgggagagaatgttccaggtagagggaacaataggtaggcagtgaagtgaacatatacctaggatattcaaggaagagcaaggagaccagtgtggctggagcacagtaaacaagtgagaggaaaagtagtaggagatgaaattgtagcaagagaatgtaagccagatcatttgaggacttgtaagccagagtcagaattctggagtgttacggaaagccatttggagggtttaaccatgtgaaagatctgtaacattttaagatcactctgacagctatgggaagaacagactaggagaaaggatggaaatagggagaagataggaggctcttgcaagagtccgcgtaagtggctcagacaagtatagtagcagtgattggaggtgatgagaaattgaaagattataaatttttttttaaggtatcactgacaggttttattaatttgttgaatgtgggatgtaagagaaagagaagagttaagagtgaccaagtgttttttgtcctgagcagctgcaagaatttagatcccatatactgagatattgggaagagtagggaaggaacagattttgtgcccttccccactcgggatgaatgagagggaatctagagttcaactttttgtccatgttgatttgaaatacctattagacatcaagagatgtcaagtaggcggtgggtggatgctatttaaagccatgaaactgaatgaggtataggtataggtagagaaaaaaattgtgggaactgtactctgcgggaacattctatccatcatcttaatttgctgtctattacttagctgagattttcttctttccccttctctcttgagcacctacaggtaaatctgtttgtgtttactgtacctatggtatgatccagtacaccacacttctaaaatagtctgaagatcaaactaaaatagtaatgcaaacaccttatctttatatattgctttgaactttgtaaagagcttttatttagcaaatgctttttatgcaccagtaactactagatactttcatacatgttacctcgtttggttttcctaaaagattgtttgtgttttatatgcaaatgatgagctggtggagatacatctttaaagaaagctttcttttgtatttgtatgttgttctaaatttataataaatataaaatatattttaattaataagaacatatgcataaagatggcaattgtatagtagacagaacactaaccagctatgggcaagtgcaaatttctcttgggtcccatttcccattggtaaaataataatggggctaggtttgaggagggatttagtcaagggtttctcaaacaatagattgggatccactcgtatttatgcctctataatcagtatagaacttttccaattaaaatctaattatatactttttatgtttgatccttatatggtaactaatgcttttgaaactcaaatactaacacaaggagtacttttaaataatagatcactttgaattgtctgtggtgggagatggtaaaattctggttgtaaatttatttagattttagaattaagagcaatttcagctcctaggatttgtggtggtggaagttattatatctaatattttctgtaaacagaaaaaaggagttcatcgttgcccaaaatgcagactacaatttttgaccagcaaggagaaagctgaacataaggcgcagcatcgtacatttataaagcctaaagaactagaaggattgcctcctggagcaaaagtgagtttgtgagggagtttttggtggttttttgcacattctattaatttttttatgtttttttttttattatggatagaaggaataagatctagtgttagaaagctcactagggcaactatattaacaataatttattgtgtatttcaaaataactaaaagagtggaattggaatgtccctaacacaaataaatgataaatacttgaggtgatggatacccgttaccctgatttgatcattatgtattgtatgcttgtatcaaaatatcccatgcaccccaaaagtgagttttaaatatgctgtatttttaacattttgtatgataatagaaacaaactactgcctggttttatctattgaatataatattaaaattgacctctgattgttattaagactttaattttaggttttatcattcttatgcttgtaaagaaaaacttctaaccattgttttttttagttgattgatgtggtttgttggagggatatttctagtgcaactagattgtagactaagttggcaggtcgtttcaatgttctgtaggctgtttttgagctattccagttgtcagtgtgtatgtctttttcagttgctagactataagatatttaagatcaggaattatatttaatttatctttgtgtccccagcatctgtcacagtgccttgaatgccataggtttgttgaagttagtattactaatctactctcagagaagcaagttttgctcctggatagcatagcattgctgtttttcatgagcaagcacacatcagactacaaatttctttctccttctttgccttatatacatatgttttcgctgactttttttttttttttttttttttttttgagacagagtctcactctatccctcaggctggagtgcagtggcgcgatctcagcttactgcagcctccgcctcccgggttcaagtgattctcgtgcctcagtctcccaagtagttgggattacaagcatgcagcatgatgtccagctaattgtttgtatttttaatagagactgggtttcgccaacatggccaggctggtctcaaactcctggcctcaagtgatctgcccgcctcggcctcccagagtgtggggttacaggcatgagccaccacgcctggccctctgacttctttacataaagttagctcttgaatattttctccagtaaagagatagataatccaaggtgagataatccctaaacatttgtatttcactttgagtacatgcttttgaatgcgagtatgtctgctatttaaattaacaaaattaatataaaacaattatctgaatatctagcataagataaaccatctggcatccttccctgcaatccatttgttccatgttggtattagacatgcagaatattaatgtaggcagtacaatcctctctcacatcttcccttattaataagataccaatagtaatgataatattgataataatgatactatatgtcttatagcactttagaattaagtgttcggtgtgcctttccatacattttattatttaacctatgtggtgatccagtgatatagacaaggcaagtattatccccatattagagatgaagaggctcagagaggctaaattccttactcaaggtcatgtagctaggaagaggtagtactaagattcttaaactcaggtcttttgacttctactctagtgctttcaaaacatgtattttctttttgcaagctaacaagttctgcttcagtgcttttctataccacatatatttcataggacttcatagaagctgttcttcaagtacatggggggagtgtaatcaaatgattaaagaaaatgttagtggatgacttttctattattaaccaatagatacaaacattttctttttccaaatagtaaatgataaattttatatgttaccattaaggaaattctgagcattattataaccaccatgctgtgtgatgaattgatataagctcaccataaccttggaagcagaaatcatgccccctgatcccccaggaagaggtcacatttactgaaaatctgttttatagttaccagagggtaatgcaggcctttccagagttattatttcagacctctatattacattttgacctctctatttgtgaaagccttttagttagttgggtttttttgtttgtttgtttttgagacgggggtctcactctgtcacccaggttggagtgtagtggtgccatcttagcttactgcaacctctgcctccgaggctcaagcgatcctcccacctcagcctcccaagtagctgggaccacaggcggatgtcaccatgcccagctaattttattgcatttttggtagagatgagttgcccaggctggtctcaaactcctgagctcaggcagtccacccaccttggcctcccaaagtgctggggttacaggcatgagccaccacacccagccctttttaattctatcaaagcataaaatagctatggaatgtgctcttttgatatttatctaatttttactcctaattattcgttaatatctgttaacatacaactgttatcaatataaaactaatattacaacagtaagtaaatatcaagataaatttcatttaatcagtatgaccatttagaataagtagaaggcttatctgattgtagtttatacttgccattttcaaaataatgattttaactttttgtattgcagtggttttttggtaacagtgttattgagatataattcatatatcacacaatttacccatttacagtgtacacagttcagtggtttttagtatattcagatttgggcaaacatcactacaataaattttaaaacatttttatcaccctcaaaagaaacctcataccctttagcattcactatttcccctccattagacctgtgcaaactttagtctgcttttagtgtctatggattttcctattctggacgtttcatataaattgagtcatacaatatgccatctttagggactggtttctttcgcttagcataatgttttgtaggttcattgatattgtaccatgtttcagtacttcattcttttttgtggctgagtaatactccactgtatagatattctacattttatcctttcatctattggtgggcatatgggttgtttcctctttttggctataatggtgctgtaaaaattcatgtacaggtttttgtgtgaacgtatgttttcatttctcatgggtatatacctctgagtagaatggctgagtcaaatggtaactcttacctttaatattttaagaaactgccaaactgtttttctttttttgttcttttgttttgttttgtttttgagacggagtcttgccgtgttgcccaggctggagtgcagtggtgcgatcttggcacactgcaacctccgcctcctgggttcaagcaattttcctgcctcagcctcccgagtagctgggattacaggtacctgccaccatgcctggctaattttttgtatttttaaaagaaatggagtttcaccatgttggccaggctggtctcaaactccttacctcaagtgatccgcccacctcggcctcccaaagttcagggagtacaggcctaagccaccacacccagcctgccaaactgtttttcattgtaactacactgttgtgcattcccaccagcaatgtatgagggttcgcatttctctatgtcctagccaatacttgttattgtctgtttattatagccattctggttggtgaagggacatctcatttgggatttcatttgcatttccctggtgactaatgacgtggaccatctctttgtgtgcttattggccgtttgtatatcttctttgaagaaatgcctattcatctattttctctttggttgcttgtgcttttggtgtcatatataagaaaccgttgcctaactcatgctcacaagaatttactactgtattttcttctaagagttttatagttttaccttttagaatttggtctttaatacattttgagataatttttgtatataatatgaggtaagggttcaaattcattcttttgcacatggatatcagtttttgtagcagcattcatcaagactattttttgccccattggaaatgttttgggacccttgccagtttaccgtaaatgtgatatttacggcttacaatgatatttttaatactaatgcgatggttacttttctaaaaatatgtattggctttgtttttataggttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtaatatcttttattcctgatatacaatacaaatttaatcttatgtatataatttatcatatcataaaaccctcttacacatttacatgataatcacttatctggcataaagaccaagcaaatgagaaaaaggtactttttacaactgctgagcagaacttgagtcattgtgtttattctctaattttcatcttttacactaaacttatattttgtgcttttatcttatgatagattaattggtttatttgatcccttttattccagggaaatgttaactggtgttaaattttttacacttactctagcttgtttcaaagcaaattttgaaattatgagtctacttaaagataccaatttaaacattttggcttcagttaataaaatgttaataagattttcccctgttatttttgttttataatctctttttatcttttttttccgtctccataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatga

SEQ ID NO: 5875 - DNA, 331320 bp, human; identical to SEQ ID NO: 5045

SEQ ID NO: 5876 - DNA, 331310 bp, human; identical to SEQ ID NO: 5042

SEQ ID NO: 5877 - DNA, 335379 bp, human; identical to SEQ ID NO: 5040

SEQ ID NO: 5878 - DNA, 333425 bp, human; identical to SEQ ID NO: 5044

SEQ ID NO: 5879 - DNA, 329093 bp, human; identical to SEQ ID NO: 5041

SEQ ID NO: 5880 - DNA, 328428 bp, human; identical to SEQ ID NO: 5043

SEQ ID NO: 5881 - DNA, 115387 bp, human
cagtcaatcagcggcagagctgagaagggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtaggtgggcacacccgggaggtgggcgcagagaccgacacttcgggaagggaggctgcaactcccttcccccgccccgccgccccctgcgccggacgcaggtacactagagggagaaatgggcagtcgagagggcaggagcgagcgagcgagagagccaggcagcccgggcgcaggacgttccccgcgggcgcagcgctccccccttcccagcactgcgagcggaggggcgccgccgggttgcccagtgcgactgtcgcgctccgctccccgcctccgctcctcctctcccccctgcattattcgccgtcccgggaagcccctgaggactgtggccctcaaagtgcgtgtcaccggctacttctccttttccgggttgaactccttataggacgccccgctttgttgtatgggtgaggagaggccgggtgggggtgggggtcgccagtggggtgtggtggagggaaacgtcccggagcttgctagattctgggggtcgcaaaacgtggaacttgaattgatgtttcattgatgttcttttaaaactctctccccgcctctcttgcaccgctgacaaggattaggagttttagtagccgcaaccgcttcagaagtcgcctttaaaaagcaaacgactacccccactctccacccctccaaaccctgacttttgggaactctcctactttccggaaggtatcagaccagaggagtatttttcccctctttcttttttcttacctcattttaagggttaattgcactttcaattacagacctttgaaaggactgattacaggaaacctgaatctcagtttggagatggttatgcaaatagagacggcttagcctgtgagaaagttcaccggattttggcgccggtggggtgggatggggggtgtatgggggtatttgtgaaagcccctctcggagcgctggggaggcagcgttcggcgggtgccctgcgtccctcccagcgaagctggcggcggtgtccggccgggtcccctccgggtcgcactgtcttcttagcagcggccaactgttgcgcgcagccccgccggccgcgcaggtagcccgttcgccctgggggctcagaaagcaccacgaatctagctggctggtggccagcgtaatctaacggaggagtgagagattcgagcccggggggggggctgagcctccactccgaacctttcatggaagtgagtggagcgcgcctttgccttgccgtgctggtctccgggtggggcgggcagggggccggcagccagcaaaggaaatactgtaatttcaaccaggcgcttccaaaggcttaggaagatttgggggtcattttttggaagggctattaataaccttggagattaagtgcagtcatcaattacatattaattacaaaggtaattgagggaagttgctgggcacttttggagtgtaactggcgtctgtctagaaatagaagcgaagaaattgttggagcagcccaggcgcccactgcaccttggcagttaccaaataacatgctcactactgattagacactgtttgcccttcagctgcctgtcttttggggagctcaagtatgtcctcaaagcggcacgattttattggttgtagagccctgaaaagccctctttctttcccttcctcctgccccgccagaaaaaaaatgaagtgaaccaccagccgctgaagcttggggactctgcaggtcaaacctggggtctttgtgccctgcacagtttaggcctgggcacagcggagatgattggcgtgaaggttacagttgtcattcccacattttgaaggggtagatgcagctctgcacttaatgggaatgtgacaaggtttcatcttctgctcatgcaaacaatatgtgcctttgatattgactgcaggcattcagcgagtggggttgtgaaactgccctccccagtttccccaactttgctctgtgcagtctttcgctgtggcagggcatcttccccagccagcatctcaggaaaaaggaagcttgaagggtgctcagagactctgtgctaggtgttccctttgattgtcatcatccccagaaatcacctgagggatattttgcgtatatgtctatctggacattcccccatgccaaagataggggagttattagtgaccagcagcaggaaatggaagctaatgtgctcacacccaaaacattttattctttttgtcttgtccttcatctccctccctgggctgctgcttttatttccccttttgaatgacctactggactgcattctcctgaggaacaaaggaagtgcctttttagctggaatccttggaagaccaccaaggactttagctcatgcagtgcaatttcgcaccactttcaacaataacaaaaatgcatgactgaatggctcaaaaatgtggagtgttagaggcattcatttgagtctaggacactgtcacaacacagacagacccaagtaaatacctttagacggccagtatagaaacaggcgtaatctttaccatcaccctggcctctccagatgcatacattagccttgtcttctctgagctacactcagataattttggtcattttttaagggggatagtcaatatagtgacttgtattcagcctaggtctggatggattaattgccaggcactttgcctgggatggggaatgtgcttttttcagtgcaaaacacccaggatcattttccaggtgaagtatcacaaagtctgggtacctagctcattgagccccaggctcagcccaagtttaatgttttattccagatggccttgcacttgccttctagaggtttgaacaggctttaagaatactccatgttctggaggagtctcagtctttatagatcatagttaggatcatctgatgtgctctcaagggtgtcagggagtacatcatgctgacagggcttccaactgaggtcctgcattgcctgtctgcttgacccctgtacttttcaaataatgctgagtccaggtgccatgatcaaaagggatctttaacacaaagattatgtttttgttcagctttcaatggccatgtacttttggagcgcccactatgtgcagtatcctctgctcagcattgtggagacagcaagaaaggcaggaggggcttctgccaccaggacctttcctattagtaaggagataagccacgcacacacaaaattagaatacaacacagtggtgataagtgccatacaagcgatacagatgacgagaagggagtgcccaggcatttcaaagagagaagggatttaggactctaatactatagaatattaactgggtaaagctagttcactagtaaaaatgaaaatactaatgaagataagtttaaaaatctaaccattttcattatgcctccctccataaagacaaaggtaaagggtatgcaacaatgggcattttattactcatctatgttgaaattgtttttaagagtgaggcagtgggttagaagcattcatgaacttgccaaaggtcctcttcacaatgacattgaatgatactcagaactttgtgccctagttgcagttttggagtttttatttcttgttcccttctgtgttcatgagcaatgcacctatgatcatgtgctcacacacacatacatatgtacatgcacaaaggattccaggactcctataagctgttatgactacgtggaaaaaaagtacgtgtgtatgtgtgttggagaggtagcaatactttctaatagtgagttgattatatatgacacacagcatgtgtctttaagatttgtattccgccttccccaccgtaagtaatgtgttggattttgcaatgaatctgtgatctcctgttttgttggaatcatcaatttggctctgtgtttcacttggggagggtcgaattgagccacagggcctatcactgtagaaattgtcccaagtagtttacaggaggtatcttctggacatgttcaaaaaagaatttagttaaagttctggcttatgcagctcagtctctggttagaacatataaatataaaatgtctgattcagcataattactgttttccttttttatttgattcacgttgggttgcatgcaatttcaggattaactggagactagactgaggaatgaaaaaggaagttttttgttatgtgtacaagggaaacaacattggcgttaatctgaggcagttggaagtgagtctctctggctccccaatgacattaactgttttagcactgaggtttttttcttatttatgtttttaaaaatgtattttggcctcatgataagagttcgtagctattgaatgctttctctgggcctggccctataccaaggaacttacatgattgtctcatttaaaacccacaacaaccatatgacatcagaattatcatctccattttatagacaagaaaacaaattcaaagggattatgaaatatgttcacaatcttatagctaatgaataacagaggtgggatttgaacccaggtcttatctgttctagagtatagttcatgctatgttgtacagatagtaagacaagaaagtaccttctctattcccatagaggttgttgagatataaagtatgggaggaccctcagctaactagtaacagaccatcatcaaaacggcacaattttcgtgttatagtggagaggatccagtcacatcttttgtagacaaaatgtcaaacccagacatagacaatctagtgttaatggtagaaggaatataaattgtatttcctggacaatacaattgagccaatgagggtttctgagggaggggaatgtcgtcagtcaagctgttttaggaagataactagtggctctttgggttaagggttggcgaggcaagagataaagacagggaggtctgtcagcagactctttttaaatagttcttaactggtctacctgcctcttgtctgtccccccctcctaaatccctgttctatcctgaacatcgccagcttaatttccttacatcactgctttgattagagttattcctgtgctttgagcttcagtggctccaagcatctcaaatgatacttctttcattgagtcacttctgaactctccagggttatgtgcccacttcttcctaattccctgttggaaccagtccatggtctttgtacataactgccttgtattatagttaactgtgtgtgcaggtacgtgtttgtcttctcaactggaagcaacttgagggcaaagatgacaactcctcgtcttgtctgtgggtagcagtaccaagtgtggtaggtcagtgcaatatttgttaaacaagtgggagaataacatagccaattctattgtgttctctgtcagacactagtgctacaatgagattatactgccttgatgatagattgtcattccatggtctgttgatctcctaggaatcttttggatctaaacactttttttttttttttttttttttttttttttttttaaggcagggtctcactgttgcccagactggagtgcagtggcgtgatcttgcctcatcgcaacctctgcctcccaggctcaagcaattctcctgcctcagcctccagagtagctgggattataggcatgagccactaccgcctggctaattttttttttttttttccaagatgaagtttcgctctgttgcccaggctggattgcagtcgcgtgatctcggctcactgcaatctccacctcctgggttcaaaggattctcttgcctcagcctcccgagtagctgggattataggcgtgtgccaccatacccggctaatttttgtatttttagtagagacgtggtttcaccatgttggccaggctggtctagaactcctgacctcaaatgatccagcctcccaaagtgctggaattacaggcatgaaccaccattccaggcctgtatctaaacactttgaagtgaaataaatttaaagtaaatatgcatatgttggtatagcttggagaacgtttttattcttttgggggagtacttgtctttaccacttcattaataactgaatgcttataggatttttttttattttttgaaacagagtttcgctcttgttgcccaggctggagtgcaatggcacgatctcagctctccgcaacctccgcctctggttcaagccattctcctgcctcagcctccagagtagctgggattacaggcatgcaccaccatgcccggctaattttgtatttttagtagagatggagtttttccatgttagtcaggctggtcttgaactcctgacctcaggtgatccacctcggcctcccaaagtgctgggattacaggcatgagctactgcactggccaggaatttttcagaaagattcagaattgtttttcttaatgccttgagatacacttctttaaagaatgaacagttgagactgttgtgattaggcaatttagagcaaatttaccacatgcaactgttcagtgtgcatcagttaccttttaacataaaaaaactcaagtttattgtctttaccaagaagaacacaagctttgaagggtatcagaatattttatataaataaacagacatactaaaatacaaacaggtaaaaactagcattttcaaatctacttggttaaacatctgttgcttactatagagaacatgaaagtgcagaaaatgcatgaagcgattccatcctggaggtaatttgaaatattatgtttaagttctgatgcatttaattcagcaatctggtgggagagaaaaatcaaagagctgcatcagccaggtattcaacttttgagaaagaaactctaacaaatgttagaaattaggggaaaaaactgaatgggagagttaaaaaagtcaataacctccaggaagcctggaaactatgtaaaaacatcttattggaagcccagataaatgtgtgccagacatcaaaaagaccaactgctcgggggaagaaaaaaagaacccggcatgactaactggcagagtaaaagaggctgcttcagggaaaaaggcatctttcacaaaatacaaagagtttaagccagaagagggaagtccactaggtttcacaaggcccaggtacaaactagaaattaagtgggctgacagagaattgaagttgaatcttgcaagggatttgaaagatggcatgtgtgataataatggtgaaaagggtgggttgagtccaacctatctagggagaagcaatatggcttctttaagggtaaaccatgcctgattgatctctcgggattctttgtgtggaaaaaaaagcatgaggatacagggaagcagacatacatcatttaggtttttaaaaattatgcaatgggattctaaggcaaagaatattcagaaaatatatttactttgagataggtggggatagttggacagagagggagagtgagggagggaagagactccactgttgtagatggagtagtttacatggagaagacatggcttgttaggatgagtagttctagcctaactctggcaaatttgttgtcaaatacctttggtgaggttcttccctctttgaaaaatggggtgaaattgaaccacctggcacctgaggagcttttaaaatatactaatgcctgggtaccaccccataccaatgaaataatacttttttcaggaaggactaggccatgatggatggatggatggatggatgaatgtgtgtgtgtgtgtgtgtattttttttttttgagatggagtcttgctcttgtcacccaggctggcgtgcaatggcgtgatctcaacttactacagcctccacttcctgggttcaagcgatccttctgcctcagcttcccgagtagctgggactacaggtgtgtgctgccacacccggctggttttttgtatgtttagtagagatggggattcaccatgttggccaggctggtcttgaactcctggcctcaagtgatccacccaccttggcctcccaaagtattggtattacaggcgtgagccactgtgcctggcccatggtagttttttttaattttcttttttttttttttttttttttgagacgaagtcttgctctgttgccaaggctgggtgcaatggcatgatctccactcactgcaacctccgcctcctgggttcaagtgattctcctgcttcagcctcctgagtagctggaattacaggagcacaccaccactcctggctaattttttatatttttagtagagacagggtttcaccatgttggccaggctggtctcgaactcctgacctcgtgatccgcccgcctcggcctcccaaagtgctgggattacaggcgtgagccagcatgcctggcctaggtcccttccatctctgagattctattattctaaattttccaatgagattcatcacaaaatgttgtttgagataaagcctttagtttagaatcagtgcatggttgttttaattttggctaacttggatttaagagaaaggtgtgtcaaacatggaggaaaatgttttcaatcaagatataagtgtgaaccacaactgagtgctgctttgctgcaggtagagacataagacaagcacaatgagaatactttggaaagaattagaacagaatccagccttgctgtcatttattgattaagtgtcaacatgctaggtgatatttcttccctttttctttattggtaaaattaaaataaatctctttatcccttactttaatgtcctctttgccatgtgtttattctcttcaagtatcttatcaagaaatagaagtacagtaaatccctaggcttctagctggtgcaaccatccagaacacagctgggaatgtggaagtaagcagaaaagccaaatgatggaaacagctgtcataaagcccatgcattctatgtggagaaaaggccttcagaaatttattatcagcaatcattgaatggctcctgtatccagagcagtatgctgggtgcaggggattccaagaggtgtcaagcaggaatcaagcttttgaggaacttgcattcaaattaggtagatagggtttatacgtgagaagataaaatgctttggttatccagtttcccagtctatggcagattagaagtagcaaatggtattggttgggggccgatgggaatcacaggaagggatcgtgttagaggcaggtaagacttgacatctggaagaagtgagagaggacagttggagggtgaccagaagctgaatgggagagccagaacttgctgatcttggcagtttgagatctcctagaatgggcgaatgctcaaagccacctttgtaaccataatcatcgagggcactagtatatttcattacagtattaaataatggtgtttggcttattctgatttaaaagttcagaaagtacattttagaaagagttccattactgggcacggtggctcacgcctgtaatcccagcactttgggaggccaaggtgggcggatcacctgaggttgggagaccagcctgaccaacatggagaaaccccgtctctactaaaaatgccaaaattagccaggcgtggtggcacatgcttgtaatcccagctactcgggaggctgaggcaggagaattagttgaacccgggaggtggaggttgcagtgagccgagattgagccattgcactctagcttgggcaacaagagtgaaactctgtctcaaaaaaaaaaaaaaaaaaaaagagttctattggaaatattcaaaatatgaaaactacccttaagggggaaatttagttaacttacacatttacctatctagagcacccagtttcccaacagtgctggatcaacaaggagtcaatctacgtgtcactttgtctttttattttaaaaaatgtgttaaaaattgtatattattaattcagtggctttttcacctcagagcttgtggtttatgattttgttcctctgcacctttttttttttttttttgagacagggtctcactcttttgtccaggctggaatgcagtggcatgatctctgctcactgcaacctctgccacccaggttcaagagattatccctcagccttccaagtagctgtgattataggcatgcaccaccacgtccagctaatttgtatatttttagtagagatgggctttcaccatgttggccaggctggtctcgaactcctggccttaagtgattctgccttggcctcccaaagtgctgggacaggcgtgagccaccacgcccggcccctctgcaccttctttttttttttttttttttgaggcagagtcttgctctattgcccaggctggagtgcaatggcgcattctccactcactgcaacctccgcctcccgggttcaagcgattcttctgccttagcttcctgagcagctgagattacaggtgtgccccaccacgcctagctaatttttgtattttttagtagagacggggtttctccatgttggtcatgctggtcttgaactcctgacctcatgatccgcccaccttggcctcccaaagtgctggggttacaggcgtgagccaccacacctggcccctctgcaccttcttttgaaagccctctagaacatctaggttcaacttagtttctgatactgtactacctgctgtggtcagtttagggaactgagttttgacctgaagtcaacaacagttggttcctcgttaagggtgacacatttgaatactggtttcccttgtaaacatttaccaaactaggtaaatgtataatcataagaaacactagaagttaaggatagtgtctgactatgtagctatttgaaccttaaaaaaaagcaaagcttggctgggcatggtggctctcgcctgtaatcccatcactttgggaggtcgaggcaggcagatcacttgaggccaggagttcaagaccagcctggccaacatggtgaaaccccttctcgactaaaaacacaaaaattagctggggtgtggtggtatgcacctgtaatcccagctactcgggaggctgaggcacaaggattgtttgaacttgggaggcagagattgcagcaagccaagatcacaccactacaccccagcttgggcgacagagtgagactctgtcaaaaaaaaaaaaaggcagctctatgtgccctatcatgccagatctgagaaaccatgtatccccagttcctaacatactgcatggcatgtggtaggtgctcaggaacgttaagcatgactttttgtttctgtactcattccaggacgagatatttttattcatatctgctgtgctcttactctattcttctaaaattcatatgttgaaatcctaaccctcaaggtgatggtattaggaggtggagtctctgggaggtaaaccctcatgaatgtgattagtgcccttataaaagaggccccagagaaaaccgttaacacttgcgccacatgaaattacggtgagaagatggccctctatgaggaagcatgcccttaccagaacccaatctaccagcatcttgatcttggacttcctggcctccagaactgcaagcaataaatttctgttgtttagaagccacccaatctttggtattttgttttagcagcccaaacaggctaagataaccctttttaaatctaattattttaagctatctcatttatttttaacttttgcatacattcagtcctagatgcctaagtaaggaaaggaaaaggaaaacatgtttttttaccccttaacctagagcgtggtgctctttcttggcttgcttggaggtgggcgcttagtatttcatgtggtttgttttaatcccggtagacaaatggttgctacttcttacgctgtctgttccagacattagcaggaacttggctgtgcctgcagaggtgctttttctttctttcttttttttttttttttttccttttgagacgtagtttcactcttgttgcccaggctggagtgcaatggcataatctcagctcactgcaacctctgcctcctgggttcaagtgattctcctgccccagcctcctgtgcagctgggactacaggcacccgccaccatgctcggctaattttggtatttttagtagagacgggtttcaccgtgttagccaggctggtctcgaacccctgacctcaggtgatctgcctgcctcggcctcccaaagtgctgggattacaggcatgagcccccacacctggcctcagaggtgcttttagaagaggctacctttgcccctttttgttgcatcagcctttctactaggtgctcacttccgtcttcttctcctggaggtttgggtcaggacttgatctctgcatcatcgcaaccattcttttcatgctagtcctttctttgcaaagccactttgttagtttggcttttgcaggcctcttaaagcctgtcttctttcttctgttcaccttctgcctaccagagcaggctggaagtggtttcttttggactgtagacatttccttagttcaccaaacccttgacgtcatcatcccagcaagcattaagccaccagaatatttttttttccttcagttattgtttctatttcaccacacatttgtctccattgagttttcggtctggtgtttggtcagagatgaaaacaaagcactgtgtccttgcaaactgcagtgtaaagcatgtggttagcagttactacttgcagtggtccagtctgagtgggagtatcatttttcttggcagtgacttcacagaaagtcctgttttttggtgccagagtaagcagtcattacattccttacaatttatagtcaaattattatctactattgtttaaattgccttaattatagaagatttccctgtgctaagattttaaaaagcaaaataagacaactttttaccaatgtactttagaaatggtccttaaacatcacctgtcaccaggatgttggaggctatggtaaggattagttctttgtgtttatggggagattttttttaaaggggagtagtgaaatgagttcactttaaactgaatttgaattaaatgcccccagctggctggttggttaatgttctgccttgttgtttacccacagtttggaactaacttttctttctgccctctcagatctgatgggcctggacacattctgggaggctcttctggtatgaggtcaatggattattaagcagtgaggcagtcttagaagatgttcgtgtattctttaggttggagagcaaatgatgaaataacaaccttccacaataagggactgcatcaattttcttgtaatctgaataaagatttaggtgactggatgggatatgtttcagcttagctaatgtttcataatctctacctttgggctctgctttcaagatatatgtaaaatttgtcatcttaccatctcagtgactactatcctggtctcacccctcattacctcttgcctggattattgcagtcgcccatatcagttcccctgctctagctctctggctctggctctccccagcctgtgttctcagcatagcaaccagtgtgatggtattctcttaaacttagatcgtatcactcctttgctcagaatgctccaatggttccccatgccagctagagtgaaaatcaaggcttatgagcacatctgccttctcctgtgccagcccacgaggtcttctcttctcaggctttatctttatccaggtcccatcccactctagccatgttggtctctctgttttccttcaagcacaccaggcacgttcaggggcctttgcacttcttattttcagtgccttgaacaccctgctgccagatagcagcatggttcactccctcacatgtttcagggctttgattacctatcaccttaatagagaagcttttcctggtctctgtataaaataggatactcccacccccccaccccctgcagacacacacatatattcatatacttcgtccttcttcctctctgctttcttcttcttagttatcaccacctgacctgtgggcaggggctttgcctcttttattcactgccctatacccaatgcctaccacattggctaatactcaaaaatgtttgttgaatgaatacatgaatgagtactccttgcaaataggttgctcttaggaaaaaagctttcagagggcatagttgactctttaggacttgtgaatatgagattatacatatgaactcccatctgtagaaagggggtgcctaaactggattcattcattcagcagatatttagcaagtgcctattaattgctaggcgctggggatagaacagtgaataaaaaggatacaagccaggtctcacacttatggagctcacagtctaaatggtgaggcagacattgattcaataattctgaaaattggtaattagttacagttgtgataactacttccaaggaaaagcccttggtcttggatgtggggtaagggaatggcaatcagggcaaagcatagttttcttgaacattatgggcctataaggccttctcattttctaggagtagtgctttttacatcatcacaagctcccgcccccagtgaatggccagggtttgtgtttctggcagtggatcctgagatgagtcctagagcacttgtgcagtagtgcagggaagataggcccgagttatcttggcttacatggaacactttctctggttgcatattgtgaacaaaagttctctgaaaaggaatttggaggaaaaagacttcattccagtgaacagtttgtaaactggggagacacatccttcagtgtaaaacaaaagtgcacattccagagaccaaagagaggattctggtttctggttgtttttgttttgggacagagtcttgctctgtcgcccaggctggagtgcagtggtgtgatcttggctcactgcagcctctgcctcccaggttcaaacaattctcccaactcagcctcccaagtagctggaactacaggtgcacaccaccactccctgctaatttttgtagagatggggttttgccatgttggccaggctgggctcagactcctggccccaagtgatctgcccaccttgggctcccaaagtgttgggattacaggcgtgagccaccgagcctggctggattctggttttagtgcaaaagttcccacctaggttcctaagcaagtgttatgcaaatgaaagactgaaatttgcttaattccaattggttgactcagctgggccctgattggttgatacaagtgagccctgattggttggtacaggtgagctctgattggttgcttcaggggagttctgaaagtcccaaagttaaacggaggtgggtgttttcaggaaactcagaggaagtatgtcacctttagctagcaaatgaccacttgattctattttaaatttaggcctagttaaccacttgggatccaccttgaaggattggctctttcaggttcacatttgtttacaatactgtggccatcattttaaggattgggtttacaggggcactggaaaatgcaaagttaacgcttgtgtcactttgcactgttgttttctgtcctctaggtggtctgcaaaggtaccagacaattagtgctaaagcctttaggcttttatgaaaggtctgagtccgctctcattttcatagagaccacagaaatactgtcatttgattggtgggtggctcaagatgaagccccctggccttgcaatagtaaaactctggtttagcaaaatatggatggaatgcatctgtcaattggtgacaagattccttcccttgccaagcctttatcaatggtgaccgagtgggcaggttgtctcaaggagaggagggtcctggctgtgcagggagcaagtgcataggctggccagggagattaggattgtaagcaaatgcagcctgagtgataagtcttagcagttatcaaaacaggatgggaaggagccttccttgccacatgctgctgctctgagaacagagtcttccgtatttcaagaaagattgttttttcagaattttagatgaacactgtgagataggtccctatttcttttttttttttttctctgagacagagtctcagtctgtcacccaggctaaagtgcagtggcacaatcttgtctcactgcaacttccacctcccgggttcaagtgattctcctgcctcagcctcccgagtaactgggattacaggtgcttgccaccacacctggctaattttgtatttttagtagaggaagggttttaccatgttggccaggctggtcttgaactcctgacctcaggtgaactcacccgcttcaacctcccaaaatgctgggattacaggcgtgagccacggggcctggccagtagatccctatttcttagtttgttcagaaattcaaagtcctaatgaggaaccctgaggctggggtatgtatagagacactagctcggatgcctgacaattttacctagaggtacatgagtagctgtgacatcccagtgtttctgggttacaagcaagtatttttagctattttctaatgtggacccctcttctgaagggcatactacatagccatgacaaaggctgaagtcccaagctctccatttaatgcagtgaactgactgcattgttgtaaattgggagcaagtttgtaggcaaggggcaagtttgcttaaatatgaagactaaggtgagccctactttaaatatgaatttaaatatgaagattatggtatatgccctattttaaatagtataggcttactatattttgtttgtttgagaccgagtctctctctgtcacccaggctggagtgcgatggggcaatctcagctcacagcagcttgtgcatcctgggttcaagtgattctcctgcctcagcctcccaagtagctgggattacaggtgtgagccaccaccacgcccagctaatttttggatttttagtagagacagggattcaccatgttgctcaggctggtctcgaactcctgagctcaggtgatctgcccgccttggcctcccaaagtgctgggattacaggcgtgagccactgtgcccagcctcagcctactattattataagggtaagttttctgattaagaatataagtgtttaatttctcttacaatggctctaatgatccatatgctaggaggcactcagggtgtgggctgagctgcatgagcttatgatagggcaaaccaatctttatctaaacttagctttaagtttatgggtatgtgattgtctctgctttatttttatttttacttttttttttttgagacaaggtcttactctgtcacccaccctggagggcagtggtgtgatcacggctcactgcagcctcaacctcccagccttagatgatcctcccacctcaccctcccaagtagctgagatcacaagcacacaccaccatgcctggctaattatatattttttgtaggagggagttttgccatatcgcccaggccagtctcgaactcccagcgcaagtgatctgcctgcctcggcttcccaaagcgctgggactagaggcgtgtgccaccacacctggctaatttctgtattttttgtagagatggggttttgccatgttgcccaggctggtctcgagcttctgggctcaagtgatctgcctgccttggcctcccaaagtgctgggattacaggtgtgagctgctgtgcccggcctctgctttagtttagaaacagataaagcatttgccatttttttaccagtaatcttttagtgtttctcttggagtgctgagattttcttggttgcttctaagctcaagagtgaagtaatatacaatgagattctggggataagcatgcttctctctctgctgggtctgtaatgaaaggtttgttaagcaaataaatggtgtaaatattatatcaggaaatgattaacacctacatagggaaagagactattcccaaacacctcaggaacaaccattgtaatcaaaaccattgtgttaattacaaaaatatctgtttattaaagtaggtctttaagttgctttagttgccaatacttcctgcggtcactttgtgtttgaaagtgataagttcgtgtttctttaaaaatactgtataattcagcccatattccctccaataagtcaaatttatagaagacatttctgtaatcgaccatattaacgagagactaatggcaactcggctgttaggacaggatatttgtttttcttcttgaagtcctagcagctgttttatcctcatattttgcagaaaggaaaaacaactaaaaaaatgagatgtgtttttaatgtgaggggaatgcaagctgatcactaagaataaagagaaatgattgcatttggcgcagttattgatttcagaaatgtctttgaatcatgttatatgcatgagtgttatgccaatgctttgtggcttcctggggtgacatttagggaatgtagatttagatcctacattttgccaaatataaattgcctcaagtattaagtcgttttctgaacaaaaattgatggtaaaggaatttatcgctattttcaacagttactagatgtgtgatcagagagttgtgtcaaaccttgaatttttctaatgttgtatatttagtagtgtatgctgttgttgaaagtataacctcaactgcaggcagtttcctagggaccattaatttgttcttaaagtatttcagtcgtgatagtcattttcttttgaaatgaaggaaaattttgatcattaagaaagaataacagcattttacactaaataaatgtaaagtattggagatttcttctaataccatataacttaggtttcttagttatattgaattctgtccactgaagcaattgactttgtgccagtgttccttttcaaacaatttattataaacttgacctgtcctttctcatctcatatctctcttcttttcctaatatttgttttcttttaatcagtcaatattgattttttttcattaagaacataaggggctaacatgatttcatcagcccgctaattgctttagtaatagaaatctgttggtccctcaaacatcaggggtgcagttttaaaaagaagtggtaactgattcttgaaccatatgtctttaatttttacaaaaagtctagcagggcctgaaactttaaaaaaattcgtaccattctcttccaaggtttaaaaaaaatttcatttttttatttttgagatggagtctcactctgttgcccaggctggagtgcagtggcatgatcttggctcattgcaacctctgcctccagggttcaagcaattctcctgcctcagcctcccaagtagctgggattacaggcatgcaccaccatacctggctaattttgtatttttttagtagagacagggtttcaccgtgttggtcaggctggtcttgaactcctcacctcaggtaatacacccaccttggcctcccaaaatgctgagattacaggcgtgagccaccatgcctggccataaatttttaattataatataaaccctatctacttaaaattatttgatcatattcaataggattcgtacaatcatggtgataattgttattaattattaatttaataacaataggtaacaactactgagcactcactatgggcctattttgaacgcatcatgtagattaacccatttaatgtaaacagaaaataaaaaagatggaggatggagtggagaattttaaatggagtaaagaattttgaaaggctattacagtgaatgaactgtgggcttgcgggtagctgggggtaaaataggaacaccaactggttatgcattttttgtttatctgataaaaagaaacatgagagctcttcaggcaaggtattttcttgttgttgctcaatctagaaagaatgtattatggaggctgttacgtaaatgacactaaacagcttaataatcagtgttgtcaacataatttcacatggctgtttcttctactgatcttccaatagaagatcaaccaaaacaacaggtgagaaagtcaggattttaggtccatggtgttgtcttgggtctttagactaaagaatcaaactcttcctgtctttagtggtaactgcttctttcttgtgtatgagttcatatctcttagtctctgagtcagggttctcctgatgagtagctaccaacaccatgatgacaataataaatacagccacctccagtggccagaaacctggaaaaagttgcacactggggaagcaagaacctgtgtactgaagccactttagaacttggaagtgaaataattggggtgagctggacagcatcttctcttcttcttcagcccctcttttctccttgccctgatcaactctgctctcaggactttgtacctggcactgagagttgtcatactgtcataagacctccagagattatggtttatcataggataaatgttttccagttgaagagatgatagaataacagtagtgataagagtaacttaggtatgttttacatatcacgatccagtcttattcacctgcatatatacatatatatatatatttttttttgagacagaatcttgctctgtcacccaggctggagtgaagtggcgcagtctcggctcactgcaacctccacctcccgattcaagcgattctcctgcctcagcctcccatgtatgtgggattaaaggcacccgctaccatgcctgactaatttttgtatttttagtagagacagggtttcaccatgttggccaggctggtctccaactcctgacctcaagttatctgcccaccttggcctccctaagtgctgggattacaggtgtgagcctctgtgcccggtgtgcatatgtttttatatggcttaaattgtggtatgtattactgggtgtatctcctgtttttaatataacaactgtaaaaatgcttttgtggttttatacagttaaaaattgcaaatgactgaataatattcccttaagttaatgtactgtaatctattatatgtaccacaaatggatatttagattatttttggtgttttgaatgtgtgtttttttgtgtttggttttatattcgaatacagcaatgatcattcctgtgtgtttggcttctgttgaataacttccttaagttcaattttatgatacatttctttttttttctttctttcagaaggttgaaaggaaggaaactttacccttatgcctaaagtctagtctaacatcagcacatgccaaattcctctgcttacaggtgtgtaggggagggaaggaaatacgaagttgaacccagggcattagttctgagagttcaggttttgttttttttttttttctctctctaagcacttcccaaattcaccctttttcttagttctggccaggaacctgcatctactctggtttttaaaaacctagttcagcaacattcccagaaacagctaaactgttggctggtgggagagtgggttaaacctgaactacaaattagttgcttgaagggtagtgccttttcttgtggttcttctgtccttttgattggaagagggtttcccacatgtctgtgtgtctcacttttaaaaataaaacaaaggaaagaaaccccaaacaaaacccttcctaaaacatttgtcatctgaacagaacttcctagaaagcagtgtcattgtttctaaaaggaggagctcgtaataaccctccattctccctcctctcccacttttttacaatgaaatgattctatgactattagttgtgaaatggcttaattcagtttcttattctttattgaaaataactttgctatgcctagtgtctgtctctggtcaaagggcgtttcctgtgtcattggcttccacggtttgtctgctttcagctttgtgatccggagggtacagtctcgccttttaaattgtctgcctcatcttttatctttcaacgggtcctggaaagaaatcatccaacggcttctttccagtgtcagtttttgaaagatccatggcttgctttattttgacaggtggttggtgaaagaggtgctcaaagggtggggtaaaggaggagggctatataagcggaaggagaggaaagagtttagccgcttcttttggggctgtctgacaaatggcaagtgattattatgctctccttttttttttttttttgttttgtttttgaaaaggagtttgccaataaagcctgaagttgggtgacagctgtatcctttttaggaccatttctatgtctttctttaccttaaaaggctggggcatccccaatggaaacacaattgggacatacaagatgcagctgtatagattaatttcctgtaatgaacaagagtgataagtcattgaaaagctaggtgtccttatcagtaggagctgtctcattggataagccacagggtccacgccagtgtggttatctcagatggtcccagggtgttcagggatatctcccagtagccctgatttgctttagccatgctttctttagtttatcccacctctaggaataacagattgactgttgactggctactagatataagatagtgcctctctttattgtacgttaatatttatttatttattttgagacagaatcttgctctgtctcccaggctggagtgtagtggtgcaatctcggctcactgcagcctttgcctcccgggtttaagcaattctcatgccttagcctcctgagtaactgggattacaggcatgcaccaccacgcccagctaatgtttgtatttttagtagagacggggtttcaccatgttgcccaggctggtctcgaactcctgacctcaggtgatccaccagccttggcctcccaaagtgctgggattacaggcatgagccaccatgctggacctattgtaagtgaatacaactcctcacctcttctaacctttggtagcttccctagattgtcgtttgtagagttaatgggcctttattatgccacaggagtgagaatgatgaatgtttccctttaagtcttctttctgtaccagactctcctcacttcttatcccaccctttccctgactctgcaataacgtcagctgccctcagctgagccctcagttcagcttatatcttgcttgatgtgcacagcccagaattatacaataatgttccaggtgctttgcagaaaggtagtagaatgtattcttttctgattcccatgccctccttgtgttcacgaagcaatttttttgggtattgttgactgcagtacatttaacagattaaagcctgttaataattaagaacaatatgtaaggtccaaatcgatttacaaaattaaccagcagaaaaccacagaagctccaacaatacagaactaaaaggatttgggatccaggccattcttttccagaccttctcttcttgttctatcccagtcctggtttacaagtggcctcttgggaggaaaggaagcgatcagtaagggtggaaaccaggagcaaaaagcagcccacattgcctttttgtactagaactgttgttaacaaagactgcttggaaagagggccatctgctgaggcagagaaagctttctgttatgaagggatgtttgttgcatggccttttagggattcactgtaacttagagccctcattagggaaggtgtctcaaactcataagcgtaggcagatgataacaacaacagcaataatcaaaatttgattcgggatgggtttctagaaacttgacagtatacatagcttttaattccttttactgaccttttcagaagttctaaaatattttctttccggtctgatgttatcaaatttcaatatttacactagactgtaggctgatttcttttttcctattctaagtggacacagctataacatgagcacataaacatcactgccaggcgggagaaagagcctttggggatcaggaagcctggatgctagtccctgccttgctgctgaccagctgggggatgggcattcagcaagtgagcacatcaaggtcttgttcccggtgttcatgaaaggagggcgttaaacttgattatattactaggatcctttccagctataatagtctgtgtttcactgcaaatgcgttgagagctgatgagatgatctggaaagataaggggaataagaggaaagctctttcctcattgcatatgtattcttgaatataataaaaccttgaaatgagcagttctgggtaactgagctttctgaatggtttttgtctccttccttgctgtcagctgtcattctgtactgctgttagcttgctcgcttttagcaactcctgtccctccttggaaacttcccttgtgctctttggaactatagcgttaagctcatcaaaactctatgccaagtcagtatacataaagctgtgaggggagggcttctcctatggctgtggtgcatggatttttggctgatgaaaccctttgggggcttatatttaggttccagataggtaatgtgttactatgttcccatttgtcttaggctagacattagttaatacgctaattcattatgaaagatgagtaggtgggtgagaggaggaaagggaggcaagttatgtgtacatcagaagagacctcattttagaaaagatcaaaaaaagcagtttgaggtgaagaagtaggctgtggagcttttttgagacagctggagttcgaccggtagcttagatcataacgagaacgctggcttgggtgtgcctctctcacttcaagcttctctgcttgaagttgcgcactgggaagaacatgctgcctcagccagtgcctggaatgttgtgcatgaacttctgaaagactggagaccctcctccccttatgtgagtgcatagtcgctgagtgtgaatttgaacccagcagttcttccttcagaaggttaaatgtcaaggcattaacattcagataagtcgtcttactcaaaatttgctttaggatgctcctgcccgaaatctaacacccatgagtgctcattatgttcagaagagtctttcaggctatcaggtccaacagcagtatgtacccacggtccgtggtgctggccacatgtatatttcatggtcacaacagagtcatcttgggtagagaccctgggtaatttccatcccatctttctacctttcccaatttgatgtccccctcttcccactccctgtactctacatatagtgaaaccagatgagctgtttccccaaaacagccgggactgtcttctcgtctcgcccgcaggcctttatacacgtgttcttcctttagcctaaattttgccctccctaattctgctgattaacagtccttctcatctcttgtagatctttgcatctgttttctcagatgcccatctggaaattgcttttgacccatagcattttgccatgaatgaatgaatggacattagaatgatgaattgttcattcatttattctgtaagcatttatcaaatatctcctgtgtgcccagctaggtgtcagttattagggatataagagagagtaagacagacgcagttccagtcttcaaggcaatattctaccttatattaaaattggcagctgggtgtggtggttcatgcctgtaatcccagcagtttggaaggctgaagtgggtggatcacttgaattcaggagttcgagaccagcctgggcaacatcatgaaaccctgtctctactgagaatacaaaaaaattggctgggtatagtggcgcacgcctgtagttccaggtattcaggaggctgaggtgggaggatggcttcagcccaggagatggaggtggcagtgagctcagattgtgccactgcacttcagtctgggtgacagactcgtaccctgtctcaaaaaaaaaaaaaaaaaaaaaaggctatgggtagctgtgctggtgctgaggcagaaggatcacttgagcccaggagtttggggttatagtgtgctagtattgtgcctttgaatagccactgcactccagcctgagcaacatagtgagagtccatctcttaaaaagagttggctggctgggcgcggtggctcatgcctgtaatcccagcactttgggaggccgaggcaggtggatcacgaggtcaggagatggagatcaagaccatcctggctaacacggtgataccccgtctctactaaaaatacaaaaacttagccaggcatagtggtgggcacctgtgtgaacccaagaggcggagcttgccgtgagccgagatcataccactgcactccagcctgggcaacagagcaagactccgtttcaaaaaaaaaaaaaggagttggctgttggttttattacttctacagggatgtaagctccttgaagccgtcaggcattatatcttgttcagctttataatcccctatcatgccttacatatagtacaggggctcagtaagtgttactaactcagtttggaaaatgcccagtttcctttccgttaagaaaagtcatacatgtccagaagcctattccaaggcatcatctttgttgtagcactttgatataacaacagtggttatgttaggctttgaagcacatttttccctcaacatcaagtggactaaaaacacagaaggttaagaccggtcactgacaggtacgtaaagggtcttttcaccgtgaagcttttaaagtaagggctttgcccatttgtggtcccaggtaggtgtatattctagcctgccacctaccttatggccagcattgctaaagtccctttagcaacaaatctgtgtatctatctattgaaaagatttgttgtcatctatggcatagaagagccttgcagaatacttgtcccataaggcttttagacaacacaaagttgtgggaaaaacagttcctgatccacctagttttgagcttaagtcttaacatgaaaataatatagctagggatgatttactctgagctggatggatacttaatgttagaaactgaagaagctattggggaactcaattcaagcatttgagccctatcggtgctgcactagagttaggaaaataaaaagctatgacctcagaagtccaatgtaccatgtaattaataatcaacaaacatttcgaagtatgattatgaaatgaaatctagcgctcatttacaggaaacactgcctctattacaaatgatagacttattgggtttatctggcattgcctgtcctttaagtcctatataattattcctaaacctttcaggaaagaatttgagcataatatcttaaactcataagctataattcactaacaaggttgaaatgaaaatctcatttagttttctgtgcacttttccttctttttttctccttccttctttcctttttttctgttttcttcttttttcttttcttttctctctctctcttcttttcttcctttttctgtcattgcttttctttggtgaaatgcttccaattctctactgtttacattctggcagacaactataaataagaaggaattaatatccctgcaaaatgctttgggacattattcgcagcatataattgaaacccactgttttctttcatgcagcattactacaataacaggaaatactgggagaccaaagtagagcctctcagcccaccctaaggatatctgtaggcctttgtccataaagccactttgctcttgtgaactgaggctgatatgctatagccaagtaagatttagtggatgtatgtgaaaacaggatcctgtcggggtacagttgaatcccatgtcagcacaggttgaaacagccagcttgctagcggtgtaggtattcctttttttatgtagtgaagattccaacttcttctgacaccagcatgtcaggtcgcatgaaacttcctgattcaacactcagagggagggactatgggcttctggctgcctcctccttcaagtattaagacagaaccttccctctaatgaccatgagaattagcttggtgtccaaaagcattgggtggattagcatgtgggttattttttcccaaaatctaattctgcataaaattggcttttgtctcaaaaccataaactaaagggattagaaactgggggtggggtagtagtctttgtactcagagaatagatacttttagttcaagtatgtcagagcgaattaggactattaatgctctaacaaaactgctagttattgagatggtccttaaaacaagggaggccagggggcatctgaatagacagatttctgacttaatagccatgtctcaggttgttctttagtctccgagaatatgcacctgcctcccatttccattaatgtcattaggagctgcatattgtatataatacagggtcatcagggtctttattgctgttctttgaaacagaataaaatcatgtccctttcattctatctgaaacattttgtattaaaattaagatcccttaggctttgcccaattacttttcagataaagtttcctgataatgtgcctagagcagttttaatttaaacaagcaaatatgtattctttgtttaaacattttcctattccatttgtgtccctggtagaatcatctgaaagaactgcttagaatctttttttttttttttttttgagacagggtctctttctgtcacccaggctggactgcagtggtacaatcatagctcactgcaaccttgacctccttggctcaagcgatcctcccacctcagtctcccaaagtgctgagattacaggcatgaaccactgtgctgggccagagtttttttaaattttatttttattttttatttattttatttatttttattttttgagttaaaatggactccagtgcttactgttaaagctatttaaaagccccctcctccctaggcccccacataggaaagttgctgcacagaaaacaaatatcagcaaagcctcgatcccagtcctgtccccttgcctagctggtattttggggctgtcctttcattttagcattagcctaataatatgtacacatgtataatacacccacaaatcaaacgttagttttggctgcctcactgttggggtggtgatgtgggaaaggaataaaagctcagcaattagatgacttgcattttaactagtattggaatgcctgttctgggttaagcttggggccaggaactttaagtacttaattttgatgaatctgttattaacttcacaagcatctcagagaggagtatttttatcttcattattctgatcagaaactgaacctaagtttctgtaactgtaaaataggataatgccttcaagagttatggtgcagacaaaataaaatgataatatacgtgaagatgctttaagcaccatatgtatgtgaggcattgccattattatgacaattacttctattctgatgataaatactttcaagtaaaaatcaaaagcaaattagccagactttttgactgttcccgatgtttaacaactgaattcttcggtgtttcttacatttcttctaagaccatgtagatcatgaacacttttatgctcttttccccatgtcccccaacctgacaacccataaaaattgccttgaagagtatatggcttgcaaatgtcactgcaagtcaccctgtttgcaatcccaagcaatactgagtccttgaactgaatgctctacaacaaatcaaaaagaatgccttcctgtgagatagaggctgtgttgtacttaaatatacttactttattcactcacagctggaaaggtgcaggacagtgataacgaggtaatcctagactcttggggacatcagttagttacctgtattaagatgcattttaatatttttgtacaaacagatgtgagttcattatgagtcctgatttagggttctctggctgtgacctgaggcctgtggaagtttcagagggcttctgcagagatcccaaaaggcagtgctttcctgctgggttagagactatgcagagagagtgtttaaacagagtccagcttgacagctagcacagatactctttctgttgtgttgggagccagtggtaggtcagaaaagggaacactggctattaagagatttgcaggaggcgtaagggaagggtttgcctgagatctgactgtcttggtagcttctcagcactcctttttacccttgaggtctttgatgacacccttgggaaatgatgcccgacctgggacctttcatggttcctgcttgtacctgtcacgctatagcccggggcctgagccttctggagccttccagaaatgcttcacagaaatgctccacatgtaccaggacaatgctcagagtctgcttttggattgggctctcactcctactcaggtaattgtgcatccttacgtaacctttcaaaccgaagactgagacatttatagcaaccctaaagttcctctcatctcctctttcctctttcaaagtttgaactttgagattctcaggggaaacaacttttttttttttaagaaatgactttaattcactgcaggttttaacaacagggtatggccactctcctgttttcatctgaaggaaatggctttgtttgacagagatccttaaaacttattaacttttgaaaaatcaatagcactattccttccaggaaaaaagaaaaagaaaaaggctgtatggctcctttttacaaaggagttaaaattgtcagaatttgttaggccttttacatttttatcttgcgcatagccatttgctctgggtagtggggattgtctagttcatttggacacattaaagtgtatgtctctgtgcatttccagttccctgaagaaaattctcgagttgtattgttacaatagtacagagagttttcatgtaccttctaccccaacacatgcatagcctcccccgtgattaccattccccaccacagtggtgcatttgttacagtcagtgaacctacattgactcatcatcatcacccaaagtctgtaagtttacagtagggttcactcattgttttttgagatagtcttgctttgccccttaggctggagtgcagtggtgtgatcttggctcactgcaaccttagcctcccgggctcaagcaattcttctgcctcagcctcctgagtagctggaattacaggcatgcaccacaacacctggctagtttttaaaatatttttagtagagacggggtttccatgttgcccaggctagtctcgatctcctggcctcaagagatccgcctgcctccacctcccaaagtgctgggattacaggtgtgagcccatgtgtccaggcaacagtagggttcactcttgatgttgtatattctgtaggcttggacaaacatatagtgacatgcatccatcattattgtatcagacagggtagtttcactgccctaaaattcctctgtgctccacctattcatcccttccttccatcaactcctggcaaccactcatctttttgactgtctctatagttatgtcctttccagaatgtcatatagttggaatctgtatgacattccatatgtcatatagttggaaacagtacgtagccttttcagattgacttctttcacttaataatatgcatttaaggtttctttatgtcttttcttggcttgatagttcatttcattttagtaccaaaattctcttgtctggatgaaccacagattcacctactgaaggacatcttagttgcttccaagttttggcaaattttggcaattaggaataagctgctataaacatctgtgtgcaaggttttgtgtgaatatgttttcagctcatttgaataaataccaaggagagtagttgctagatcatatgataagggtgtgtttagttttgttagaaactgccaaactgccttcaaatggctgtaccatgttacattcccaccaacaatgagagtttctcttgcgctataaccttgccagcatttggagttgtgagataccattacatgcctcactgttgttttcatttgcaattccctaatgacatatgatgttgaacatattttcacatgcttatttaccatgtatatatcttcagtgacgagttcgctgagaccttttgcctgtttttttgtttgtttgtttgtttgtttgtttttgagacggagtctcgctctgtctgtcgcccaggctggagtgcagtggcgcgatctcagctcactgcaagctccacctcctgggttcacgccattctcctgcctcagcctcccaagtagctgggactacaggtgcccgccaccacgcctggctaatttttttgtatttttagtagagacggggtttcaccgtgttagccaggatggtcttgatctcctgacctggtgatccacccgccttggcctcccaaagtgctgcaattacaggcgtgagccactgtgcccggccttttttttttttttttttttttgagacggagtctcctctgtcacacaggctggagtgcagtggcacgatcttagctcactgcaagctccacctcctgggttcacgccattctcctgcctcagcctcccaagtagctgggactacaggcgcccaccaccacgcccagctattttgtattttttagtagaaacaaggtttcaccatgttagccaggatggtctcgatctcctgacctcgtgatccacctgccttggcctcccaaagtgctgggaatacaagcatgagccaccgcacccgacccaccttttgcctgttttgtaatcaagttgttttcttatgatcttaatactttttcatcctatgacaagtgttaatttggttagctggacattttggttttgattacatattccatttagatatgtagggcttaagtcagattatgccaggtatatgttcccttgggcttgctgaaggattcacttttattaacttgattctggtgaaagggcgtgtaaaaagtgagactgatcaactaaatgtgccatttaacccactgaatgcacaaaccttgcaggaaagtatagtcagttcactataacacaacatagtcatttctaaaaatcaccatgctatgccaaattgtgtggtaagacaacagtaggcgttatgggaaaattggggttagggcacaacactaacaaacttatccactgacacattaaaaaagtaaaaaggaaccaaagaaacttaggagcacagtttcacacatgctaaatggttaagaaatacacaaatattgccatacatatggcatgtgaccttgaagacatctgaagtttaactgtggacagggaagtcagaagggttccagcttgtgtgagttattatgaagtggtggatggagagttatctgaaatctgatggaaagctgtagcactaactgtggagataggggtggctcataccactggactgagggagctggtggatgtttaatatatgtgttttgcgtatttctacatggctgggtacagctggttgcggtttcctgcattcacctcctatttctggaagacaagctcacgcataaggaaacgtgaaattttcattatgctcaacttcttccttaatatatcaattgcattgaaacaaattcacattttcaaaataaatgtgatagcataatagactgtaactaatatcctttgttgcattcttgagcatatgttcctttcatcctcatagtagctgctcacgtatgatctcctttgtatgtgctgcccagaagtgttggtatctggggcccactgaccccggttcttttatcacctgtccattttttctaccatgtgcctcttgtgctgcttaggagggccagttagtatgcaaagagtagacttctggttctatgttgagggaggagtgcagggctggtaagagctattgcttactaaaaattgctggtgtggatgaggcatccgccagggctgagctctagaaggattatctggagcttgtctaactagggctcactgcatatttgagccctcgaatggactgtcttcataaagtaattaaaagcatattggaagcacatcttctttctaatctctggcattggatcttagcaggactgtattcagttgtgtctacatctgttttgtgtgcaatttgcctctcacggattatggaaaccatctcttgctggggaagctttcagtcgtgttaaagactcatttaccaagggaaaacaacaccttagaaaggaatttattttcaaaaatagacatccacattgcatataaatgtatatagataagtgtttcaacaacaacaacaaaatgctgcccttctgttccaggaaataaataccttatattcagtttggcgggagggattcttctcaaactaaaactgttctcctctatgtatatcatttcctgtaattccctcactaaagacgctttggattcagaggggctatattattcttggaaagttttggagttttccaaagattgactgagatagatccttagccttacaacttcttgccatccaggaactgcatcacttttttggggggtgggggtgggggtggtgcgggcagacagagtcttgatctgtcgcccaggctggagtgcagtgatgcgatctcggctcactgcaacctccgcctcctgggttcaagtgattctcccacctcagcctcccgagtagctgggattacaggcacccaccaccacgcttggctaatatttgtacctttaatagagatggggttttgccgtcttagccaggctggtctcaaactcctggcctcaaatgatcctcccaccttggcctcccaaagtgctgggattacaggtgtgagccaccacgcccggcccacatcacatgtataagactccactgcttgattaggaatgggaccttggagttaggatctggcactttcgaagtttttgtaaagaaaattcaggactcctcagtctccaggtcaacgaagtccagttttcatgttattctgttattgtttgctatttaggattgctgtagtctacagagatgtaactgtttgaggtggaaaatagaacatatggtatttttgcctagagagcgagggcagtggtttttattcttggctgaccaattgtttctctttcttaagcactttctatgtgccagcattgtgatttttatgggttatctcctttaatcctcacaaaaccctgtaaaatgacccctccctcactttccatataatggaactaagacttctctaagtcacttgcacaggatcagtcagcatggatttgaacccagatctttcatttttaaacgatttcattttttttgttgaaactcacataacataaaattcaccatttcaaccaacttaaagtatcagtggcatttagtatataaacagtgtcatccaaccattaagactatctagttctagaacattttcgtgacttcaaaagtaaaattctgtacccattaagacaccacttctcattcctgcctccccccagcccctggcaaccactaatctgctttcagtctctctggatttgctcattctagacatttcatataaatggaatcatacaatatatgacttttgtgtctagtttctttcacttagcgtaatctactggcactttattcccttcatggtggctgaagaatattgcactgtatggacacaccataatttcattatccattcatcagttgatgggtgcttaggttgcttctgccttttggctatggtgaatagtgctgctgtgaatgtttgtatacagctttgtatgtgaacacctgttttcagttttcttagattggaattattgggccatatggtaattctgtgttttaccttttgaggaaatgccaaagcattttccatggtggcaactacagtttacattcccaccagcagtgtatgaagtgaacccacgtctttctgactccaaagtctgtgctcattttcttaggccatgccatctcctcattacttctcaagggccctagcaattgcctgccaagccacacctccagccaacaacagaagcatgctgcagggtgtctcatgttgtgaggggatggtgttggtaatagggctttttggcttggtgaaagaacatgtgtcagagatttgtcagtggacaacctcctcttcctctgtgtcaggtaatagttaagagtatgggctctggaaccacattttatatgattccaattctttgaaatgtccagcataaggaaatccataggcagtaggatcagtggctgtctaaaatttagggagtgatggttaagttatgggatttctttttttttttttttcttttttttttttgaaatggagtctcgcactgtcgcccaggctggagtgcagtggtgtgatctctgctcactgcaagctccacctccagggttcacaccattctcctgcctcagcctcccgagtagagtagctgggactacaggcacccgccaccacgcccagctagttttttttgtatttttttagtagagatggggtttcaccgtgttagccaggatggtcttgatctcctgacctcgtgatccacccacctcggcctctcaaagtgctgggattacaggcatcaaccaccgtgcccggcccccgggatttctttttagtgtaataaaaatgttctattaacgcttgtggtgatggctgaagagatggttcaactttgaatacactaaaaaccattgcatgggctgggcatgatggctcatgcctgtaatcccagtattttgggaggccaaggtgggcagatcacttgagcccaggagtttgagaccagcatgggcaatgtgacaaaaccctgtctctacaaaaattagctgggtgtggtggtgcacacctgtagtcccagctactctggaagctgaggtcggagggtcgcgtgaacccgggaggttaaagctgcggtgagccatggtcacaccactgcactccagccagggtgacagagcgagagcctgaatcaaaagcaaaaaaaaaaaaaaaaagaaaaaaaaaaagaaaaagaaaagtatggtatactttaaacagatgaattgtatggtatgtgaattatatctcatgaaagaattttttaaagtgtagtctctagagcctcactgccacttattagctctgaacttggacaggttccttagtgactctgttccaggattcatgtttaaagggggggaggataagataatagttctgtacctacctcattgagttgtgaagatcaaaggagctaatatagataatatagtgcttggcatggtgcctgacacataacaaatgctcaatgcatgttgttaactattaatataagcatcataaaatatttttttgaagttccaactgatggatggtgttcatgatagggcagcaaagactggaaacacatagcattcctcttaaaatttaaattctttgttcaaccctgctgccaagggaaatgagcactataggacaatgtaatgggacaataatttgggtagtactgggagatgaggtcatatgggagtgggtgttgggtacacttaagggctgaaaaaagaactggtgctgttgcatgtgaggaaattgtattaaaaaggctgctctaccctcactgacaacagatgttgggaggtcttaggctctgggctccagggcctctgacccccttgaaattctctccaggttctttggaggtcatgatcccacagttggcagagccctggtgtagattagcttccttggatatgttttcctctctctttccctaatgcctcccatcccgagggtctcgaggaactagagggaggtgcttatgctagtaaagaaactagcaccttttcaaggaaaatgaaggaaaaagctgggacagtagggaaggcaggagtctgacccatggatctaggagtggaaaaagaagaacaaaacaccaagctgttctgcttgtccagttgctctgaggttgaaggccttccaggagaagcgtcctcactgttgtctgtgtccatgtttgcaggccacagacattgactatctgcccggtgcctccttgtcaatgtcccatgtgggggagagacaaaagcaaagacagccagccttcccagttccttcaggagacagaacccgaaagccaacacatgaaggcatggaagaacacttccagagaaccagctcacaagtgcaaggggatggggctgtcgaccccgtgtgtatagtgccaaggcaatccaggtcatggttgcagagtgctttactgccatttttattgcctcctttcaataaaccactgcagtgcatgaactggttgtgttttatagctaggaaaactctgagctaccaacacattaagttacttgacactgagagaaccctcaacatgaatgtcttatatctgcaaggatatttgtgttagattccatcatggaggtaggaatgcttatatcagacaaagatgcatatgcacacatgcacacacaagcacacatatgcatgcacacatgccaggggataatgatgtcagatatggggacttaattgctggaagcgagtgtaaaatgccattggtgagggctgggggacagagagagcagccctgtggccctgggtggcaggggagagcccggggtaggttgtgtgcctccctccccaacatacacagtgcccttctcagcctgctgtctgtccattagctgcacggctgctggcctgagcacacgggctcttcttggctttgagccagtggcgagctgggagcctgtgactttgagacttggcccttttcagttttctttgttcagaaaaaagtttcatcctggctgtcttcagtggctgccgaggattaggagaaccctggggagacttggctataggacggctctcaaagctgtgctgggaaatttgaagagggcccatttctctctgtcttatttcaagttacattcttctctcccttcctaaacgagtttttactgttgcaaaccctactgcataatcccctagtgtacttttgtgattctgctgctatggaagggattagaccagtatcaggaccagtaacatattttaaggactgttgaaatggacagtatgaagtaaggttcaaatttggatactcattttaaatagttgcacaagttagaggcaccacatgctttcctgggttagcatttgtcattcttaaaaaaagaaaaagtatgcttttcagtggctggaaagaaaaagaaaggaggaggcttggctcctctgagcagagcatgagaattggatttctaaatggccagagactatggtattcccaagtacaagtggtttgttttcaaaaatttgtaactacttgcagttttgcttgtttaatattgttaagaaatggaaattgcctcagttgtaaagtggttttcccattaaggattttttctttttagttttgatggtttttaccttttaaaaatagtatttatttcatgattatgaacaaattgtttttgcaaatctgattgtattacagtagataggtagatgtttgcatttttcataagctacccattagtgtaaatgtacaaaaaaatgcctttatacatctttttaccatgtttcttgtggtacttggggaggacttaactctgaactgcctccattagcattgtttcccagaggacacattaacagatcaaaaagctatagactactacatatacacataccaggagtacgtagttcagtttctgtaatcccacagtacgcaaatgttggcagaatttcaatgattgtattaatcctgtgagatactttgtcatgcatgatagatgatatttacaaattgaggtctgaaatggtcagaagctttgaagatgctttattgtgcagtatgtggaagtggaagtgtttatattgttttagaccatattggccaaccaggcagcaaaaaatatacagtctcataatagagtacaacaatttcataacaaacctgaaggttgctggggagtttttccagcctaaaccaacaaggttcatcaaaagttttgccaaggtcttaaaaccctatggataattggagcgtttggatatctcatgtgaaacacaaatccatttaaatgccatccacatacctgtgaaatgactttcttaatacatttctgtattgtagactcagagcagaatatgatagccctgctatgaggagctcctggttctttaagggctccacttgattaatcagagaggatctgagcataattaagaatcacattgtatttgaagactgggaagtgggagcccaagaagggtcactgattttttctcaaggtcatacagtcagatcaactcacgaggtcttgtttcctctctacatgtataacagactgtaggttgcttttgcccctttcacccccaactcctgcgatttaacacttttaaattttgaaaggtttccttacttaaagaagttcttggttcaccctggccctactctttgtgactttgcacatttcctttctctttccctacctaccttccacctttagtctgttcctcccactgggcttctcccttcctattcctttaatttttgctgcccttctctaaaacttttcttcatagtgttcatgagtttgagaatagcacatgtcactctaggcacaagcaaattactcttttgtataaagagcaggcttgtttcatccctttggtggctatgggttttctcagactctcccccacgttgccaaacacttgcagctcagcactatcatggattggtgtctttcccccagctttactgatatataattcatatactataaaactcacctcattaaagtgtacaattcagtggtttttagtatattcatggagttgtgcaaccattacctcagtctatttagaacatttttatcacccccccaaattaactgtgtaccattagcagtcacccctcatctccctccctctctttctgccctaggcaaccattaatctgctttctgtctatggagtgatgttttgagggcccagtctacaatcacttccctgtgataagaggagtcatgtggctactcacttgctcaccttgacagtggcctgcctgatgtttgctcattttcctccattaatttgacatgtcactaattactttagtgtcaaagttggagatagtttacctctcctttcctattctagagactccagaaagggaccttggacaaccttgaagtgaattgcctttctgatctctgactttctacaaccccgtttttggcagatcatcaactaccctttgcccctgagccctggtgatgggaaaccccaagaactggaagttcccttgaggttgggattttgtaacctcagcgctgagcctgatgcctgcctgcctgccacatagacactcagtgtcactgaatgaatgaacttaagcaatactgttaagatggaattaccatacctttttgacacatctgtcactatgaactaattgagcttatttatgctctgtgtgtgtgtgtgtgtgtgtgtcttcaataacccaactgtagaatcattttaaaaatagcaagtaaagctgatctcagaataaattctaggtgcatcccatcttgtgtacgtagcagaaatggatgcatttctccctaccttctgtttcttgtgttgtatgttcgattcctatccaggagaaaacaagatgaggctttatgttttagggaagaaaatggaaggtttagagaacatgtttttatttattgttttctaaaaatgctatagaaaacagtactccaagtagctgttttgattctctttaattcctttcttcttcatctgaggatgaacatctggtagggagtgcttttacttgcaatccagtacactcctattgtcagtccaaaaatatgtggaagtaaagagattccatctcagacccctccaattgccataacagtgggcctgatatagaagttgagaaggtgtcaataaagtgttaatggagatactcaaggaattcagagcatttcaaggcacagcatatgttcacatccctctggtatcagcaaaaactcaaaagtgaaacctgtagggtcatttggctttcatgctgtccaacaataggactttaaaagccacacactaaggagcagaatattgaaaattactttgaactttcaaagctaactatctaaaatatcctagcaactttcaaaaagtgtgataagcaggaagtgcagcactttgtaagacacgtgcatgctcttaagcagaagcctaaaatgctcctaatttgtaccagagaccttatcaaagggcttcgcaaaattccagttcagcaattatgaggtattagttgagtttaacctctgaatcatagggtggggagtggagaattgtcatttcattctactttcaactatcaaggcagatggacctttctaaaagatggtggtgggtgagtagaaaaggaattgataagaaaaaggagggactttgaaagggcttctcttttcagagctggcatgactgtctctccagtactctccctactacacatatttctgttttgtaaggagcccctaaggatacatatacagatatccttgggggctccttgcaaaacagaaatacctttggaaagttaaaagaaaaaatggggtttcctataacctcttttttttttttttttttttttttaaagacggagtcgctgtgtcgcccaggctggagtgcagtggcacaatcttggctcacagcaacctccacctctcaggttcaagcgatcctcagcctcctgagtagctgggattacaagtgcctgccaccacacccagctaattttgtatttttagtagagatgtggtttcaccatgttggccaggctggtctcaaacttctgacctcaggtaatctgcccacctcggcctcctaaagtgctggaattacagatgtgagccaccgcgcccggccttccatacctcttttaagctgttgtcccagggtctgggtggagtggcttgtgtttgggataggagcagcactcatttcaatgaaatcacctgcagaccttggctccattttagaatgacttagaacgtcctgagaagtaaattgcttatcttggggcctcagtttctgttggataagttaattgcctctccctatgaaaaacattttaagtggtataatggcctaaggtttgttatatttatattaacgaatttggacaaagagaaatcaactcaagcaatttttttttctgtcaaagaaatgctatacccattaaggacaaattttgtgtataaagatggctttatttatatttagaaatgatggctgcaggcttttatttgatgagtttgtttagattacaaaacctgagcatattttagcatcagggcaggggggctgctgatctctccaaaaagacaacagtgatttgagtaaagcaagagtttgtagtaatatatgtgtatgtgagtttttaagttctgaaatggatagtaatttaaaataatgaacaccagaattcaaaggactacatatttgccttaagaaaataacacagagcaaattgcctcttagcgatttatagttttatactttgtcttgtttgttccactggtcatggcaaactctgggaagagattttgaggctagtctgagccctagaagtcaagaataaaagtagacttttagttaacagtttaaaactttgccatagtttccaattacatttatatttgaacaggaaggagtcttaggacttttcttcatttcttaatggtgctcataaaacatagtgaatgggaatttgctttaagactaattgtatgtgtgtgtacgggtgtgtgtctgggtgtatacacacccacagagacgcgcatattaactaagttgggatgccatagttggatgagttttcaaatattttagcaaaggtttctgagcactcatgaaacaaaagcattaaggattgcttgtcatagctaataaagttttcttggatctcacttaatttttctgcttcacttcacagagtaattgaaacttcctttttgctttgagttcccctcaccccacccccaagagctacagtcttaaaaggacatctcttttggttagcagttctatggatttttttctgaatgtagaactaggtcctcaaatagttattgagctagtggtcattcaatccttagaagggaaattagttaaatctgtaagtggcttctggaggttgaagaacatccaaggagaataaaggcttattacaactggagcatttcaagcatctgttgtgtaagcctggaaatgtgatccaggttgaaaagtagagatgatggaactgttccattggaacagtgaaggtatgaaaaaataagctccaatctcaaaaacaaacaaacaaaaaccctgaagaactttataagtataggaattatcagttgatgcagattagccaaaatgatgaggttttcctgtgctccatcaatagttatttgcttctttatttcaaatcattctctagaaaattgtctttctccatcaaatgaaataaccttggaagtcttaaccaattcttgcaaaatggctcccctctgtcttccctccagccatgttttgttttgggttaacagtaaaagacaaaacagattgttgactttttgccagaaaattttggggacagattttgctgctgttgcttctgacgtgaacaaaaacctcagattgcatatcttctattctcagggcaaaaacttatttttgaagcaatgtgggtgggttttgaggcgtgctcttctgtttttgttttaaagcatttggtaagaagacacttgactttgaaattttattttcatatgtactggcttgagagagctgacctcccacctccactccatctaccttgtcaactttgatttttaacgaagtaatcaactagttgatgtaacatgcttattttaaaagcaatcatatgggagtgatttaacctttttttttatcaagttgagtgttaattattttgatctgcctcttgaatggtgggttgttaatagtaatattagtcacagctggtatgtgagtactcaactccagattccttggttcaatatttcataggtcattaaacaattttctgatgaaaatgatttatttaaactccaattctcaacctcttgcttttcacaatcccttaggataattaaatgcccagtactgcacccctaactagttacttacttttcaagaatcctcacttaaataatcatatcatatgcagaaataattatcctgcaaagaaagctttgtgaatacttcggtgtttaattcagtttaaattcatttaggagagagtagtacaaaatggctgcattataattcacattgtgagcaaagtatttttaaaatattttgacattcttgactaggttttcatgtcactctttatcaaatgcatcgtactactatattaggtttctttgcttaactcacactgtctaatgggaaaaagttcaatatcatttaagacagactctagttatctcatttgagcgacaattgttctgggggaactgtaacttaacagaaatataagaaaaacaggaactagggtcaaaagccccacagggtataaaagggtcataacctctctcagaggaggcaaatgtaactgatatactagtttttaaagggcacttgattgcatgaaggaatgcagtaacaggatttaaagcaaacatacagcactaacaaagattaaattaatggtgtgccctgctctggggggattaaaagaggtagttttatataaaattattgtgagtagactaagattaatttcctgattttgcatatcataagatactgtaatttatgatatctgctgtgattcttacgtttaaagtagtacctagactttgatatgcgaacaaaattaagaaaccatgtcaaagtataaaaataatgttactcggtcgggcgtggtggctcaggtctgtaatcccagcacgttgggaggccaaggcaggcagatcacctgaggtcaggagtttgagaccagcctgaccaacatggtgaaacctcgtctctactaaaaatacaaaaaattagctgggtgtggtggcgggcacctgtagtcccagctactcaggaggctgaggcaggagaatgtcttgaacccggtaggcagaggttgcagtgagccaagattgcgccactgcactccagcctgggcaacagagctagactttgtctaaaataataataataataatgttactcaatgttatattgaagtaatttttctttatattcttagatggtaaaattaccatgctcttaaaaaaaccttaaaagtgaagttctaagtgaatcaacacaatttttagatgatatgtcatgagaacacaaaacacatagaaaaatggtaaattttattaacagtgcttttatgaattgaaaaccttcccttagtgttggatacggaggctagaatgaattccacaatcaccgtggatgtttggagtcctgggaaatgtgctgcagagctgtgtaaatgaagtgttgctgcctccaaggtgtcttgggcctaggttggctatccacataattgaaattaaagtaaaacttcatatgctgccaagaagacaacaacacatccagttaatctccaatagtgttttaagatgattcacaattggaagataggtaacatggtgtttaacaggtatgccatgttttttgtcattttattcaaaagaatctcagcaaatagataattttctttttacatttttaaaaaagagatggggtctcactttgtcacctaggctggagtgcagtggcactgtcatagcttgctgcagcctaaaactcctggcctcaagcagtcctcctgcctctgcctctcaaagtgctgggccactgtgcctgccacttttcttgaaaaattataggtaaggaaaggggctcattgttccagtttcgcctagcacagttcagctttacacctgctgtcctagcatagttgttattgttcttgtttggagacagagtctggtctggctttgtcaacttacccggagtgcagtggcacaatcatggctcgctgcagcctgaacctcctgggctcaggtgatcctctcacttcagcctcccaagtagctgggactacaggcaggcaccactatgcccaggtaattttttaattttttgtagagactgggccttgctatgttgcccaggctggtctcaaactcccgggctcaagcattctcccgccttggcctcccaaagtgctgggattacaggcattagccaccgcacccagccctcagtataattgttagtggcaccttctttcactctcccatgtgtcctggtttggcctataatttgtggtcaccctaagaacaggaaacagtatattcacagaaagaacttgctaattaaaaatgatttaaaatagttttgcttaggaagaaaacattatgagaactttacattttttcctagacataacttagcctaaggttgaggaaggagacaccatcaagtcgatctcctggctaagcaggttacatatacatcgcaagagcactttacaaagaggcaagaaagccctataccccaatgtctgaaaaggatcacacagagtagaatttaatctgattttgatggtgttaccaatggagggtattgactgcaagttgtctgagttcttggcgttttgaacaaaggattggacaaaactcacagcaaagcaaggaataaaagaagcaatgaaagcagagatttattgaaaattaaagtatacttcacagggtgggagccacctgagcagcagcttaagggccctggttacagaatcttctggagtccagataccccctagaggtttcttactggccacttggtgtacaccccatgtaaataaagtagtggctggcaatcagaggctgaagtgaagttacaaaggttacaccctatacaaccaatcagaggctaaagtgaagttacaaggttatactcctatgcaaatgaagacttggcttgcaatctgattgattgtggaaagcaaccaatcagaggtactttcaattttccatctgccactctgtaagggatgggggtttgcaaagggagtagcctctctggtccttttgttacttaggtgtggaaagttggggttttcctttcaattcaccgtgaattggccttaggttccctgcctccagaccctattctcctgcctcagtggcacctcagggccatcatttcgaatatcacttacttctaccctggctacacacacagatgcagtaagaggccaggcccacagtctagaaggaattgttcaccatcctattataaatcattttgataatttttcttaagtgcactggcttactgaggtttacctgccactttttctgcccacagagtctcacaagctggcctgtgttctgttctctgaagatcccatgcactgtagtgcttagtgctggctgtagtggagcccaaccttttgtagtctgagaaaaccagtggtgtgctctataagtgagacagtattcagtgtgcagaaggtacttggcagaactataaatccatagacttttggaaatatctctaagatccataggctgggaatcacagaactgaaccattgaaaacatgtgtgtgccattatgtaataacatttggagctttggtcttggaacttgatattatgatctgacatgcttttacacttgaatcatctcagtgcatacctgattcatgccttcattacatacttttgacctctgaaatccatgaagctgataaggacttgggaaggctgctctcatagcatgtaaacacttggaaggctgatgaatgttctgctgtagtgttatatcctttctgtccagctcttgagggattgcttattaacatttcattatccagtcatctgccatttctgttcttactgactaaaaaatgtgccctgtaacctaacatccagtataggacgttgctccatctttttgcaaagaaaagtatgtgaaacaactgtaactatttaggaaagatgtgtaatgcagaaaatagtgcatatttgtaggttttaacaggcttatttcctcttctaccaaaaactaaagagaaatcagtctgcaggtttagatctttgaaaataaatgcattctaacttttatatctttaatagagattcctaagatgttagtgttctgaagcatctttactatcattgtttgcatccagcatcagattaaaaatcaaataatttgagtgtgatagagctgttcgttggagggtctgcttgagggtagggaggctcaagagacccagatctgaaactcagcagcctctcaaataggtagttttgacttgggggcttggcaaaatattgtcataactgcaatggaaatggaagtgagaagaggtggatttatggcatgatccacattagactctgagctccctgagggcagagaatgtgctcatttttatctttagcattttgcactgtacctgatgtattctagttactcaataaatgttggttgagtgactagagaaagaaaagaaagttggtgaaggtcgaggcaaagcaaacactgtagtggtgaacggttgatgaaattgtcataaaaagatgaagttttaaaaattaggtggaaaccacagggtgtgtctacaggcagccaccaaaactgcagttgcaataaaataaaacattaagaaaaaaaaattgagaagctttaacaaaaaaaacttacttggctttggagctaaaattccacagctgtaatcagggaaaatgctctgcccagcagcctgagtaatgaataaaaagaattttcagagagaaaagaaatcaacaagctctgtgactccccccagaaaggccaattgctgcctcccaccatcttttgacaagaatgacattttacccacccatgccaggcttctaaaataagttgataatgtttgcactcgctgtattagtagaacatcttgatatagaatgaaacagtcttaaatttcttagctactaggaagcacgttttttagctgtgtttggaacagtgagtattcttagattttcagcagcattcgtgtctagatatctttggaataatttgttgtgttctgatcctgagagttgattatgtgttctctttaccatttctgaaagatgtaattcacatgaaagttattaaacagaaggttatctgattcttatttactatttcattctacttttacaattatgtgtgtatattgaagttcagaatgccctgtctaaattttaggttgaaaacaggaagtagtgactaaatttaagtgtgttttcttatttgagggattaaaacccttgttttggagtttgttttgttttgttttggtcatcacttccaatttaaatgctattgttgtttctggttgcctgagcagtatgaaacatcagcttgtggagaccaataacttgtgttaagcttaaatttgaggccagtccagatggaattcttcactccagaatgtctgtgaatggcatttcctcagaaagtgtaacagaatttttggtccgtatgaccaagcaattccattgctaggtataaacccaagagaattgaaaccctatactggggtgggggttgggactcattctaactttggaaattcttgagattttagtgttctaaaagggtttctatatcaaatatatacagcatcagaataaaaatcaaataatatagacatgttggtagcagcattagtcacagttgccaaaaggtggaaacaacctaaatatcaatatcaactgttgaatagataaacaaaatgtggcatacccatgaaatggaatattatacaaccataaataagaatgaagtactgatacatgctacaacatggatgaaccttggaacactatgttttatgaaaaaagccagttcagaaagattacaatatgcatgaatctttttatgtgaaatgtacaaaataggcaaattcatagagacagaaaatagattatgcttgcccagggctggtgtgtgtgttggggaagggttggaggggtgactgctgataggcacaggatttctttttggtgtaatggaaatgttctgggattagatagtggtgatggttgcacagccctgtgaatatactaaaactcaatgaagtgtacactttaaatgagtgtattgtacaatatgtgaattaaattttaaaacatgatgggggggcaatttctggagaggggagcaagcaacatgcccagcaggacattattcacttgagtttcagatttgtagtactctaatgctaacagcatggtttgcctagctgatgagggttggggaaaaagaaaatcaaaagctggaccacaggagaccagggttctcgtcctgatcaaatgcatttctactgtgcaaccttgtagatagatgttgggaagagaggaatgagaaaaactgtatatccttttcataattaaatgattgagagtgtttggggaaggacaagagaaaaaagagctgtatgtttaaaaacagaaataggccaggcaggtgtggtggttcatgcccgtaatcccagcactttagggtgactgaggcaggtggatcacttgagcccaggaattctagaccagcctgggcaacatagtgagacctcattcctgcaaaaaacaaaacaaaacaaaagaaaacaaaagcactaaaaataactaaaaaatgataataataaaagattttaaaacacagaaataaacattcctcagggcgaggatgtgcatgtgtggttaattcctaatactgaacaaggcagggttttgactacagcttagccagacactccttggcctctctgccatggcattcccagctctctgtcagaatagcaaatcgtagctgacatttgcttttccagaaggaacacccttttgccccattctaccgtcagcctggcttttttgtccggatttacctgttctttgtagtgggagacagctgtgcaatggatgggagcttgagggagcccagaaacctcttctaggaccacagcagcactcattcatcactcagagaggaaacaagtagtttacgagctttcactgaaaagtcatcattgtgtaggttttcatgaaataaagattgtgtgagccatcacacagggctgttttcaggacaactctgacagaggatgtttgttccttccagaaatgctggcaatattgtaagcttttcatccctttaccagggcattactctggtgctgttagtgtctgattctgctaagaagtaggaaatgttaagaaggcattgttctaaagaaatgatccccaaatatcagtgctaagtgccatctatgaccacacacatgtccatttataaaatgccttataaactgggagcagtgctgggtttatatcaaagttcaatctcaaaatcaatgccatttaaaattgtaaaaccattcttaacttgttctttcaaatgtagaacatttgtattatgtttatgttacatgtagggcacagatatggcatgtgacatttggtacattgacatttttagaacaaaaatgagtgacccactgtttttccttgcctcttctgttcccttctctgtctgtatttttccttcctctcctctcctcccctttccttcctttctttttttttttgagacagagtcttactctgtcacccaggctggagtgcagtggctcaattacagctcactgaagcctcgacctcctgggctcaagtgatcctcctgcctcagtctcctatgtaactgagaccacaggcgcaccccaccatgcccagctaatttttaagttttatatagagacgaggtctcaatctgttgcccaggctggtcttgaactcttgagctcaagcaatcctcccgcctcagactccccaaagtgctgggattacaggtatgagccattgcattgggccttgtctatatttttcaagctctttgcttctattattgtatttaatttgttttggagtttttttcttactcagaatcctgcctcctcattctttctctttttgagagaagagcaacttttgctttcgggcactctaatttacaggaaaatgaacgatacaatttatgcagttttgtgttctagaaaatttattatttcagccttcagggttacccaggttttgtatcatttcatttccctggagcactttacacatttaatggcaaagaccagcaatggtgcttttctggtgtatgcagcagcttgttctaaggcatgtggtttgagagttggcgctacttaatcatcttgtttttttttttttcttgagtgttttggatctatttcctccattgagtccaagttgtcttgagagaactcaagaatggtgtgaagtgtatttagcagaatctctcttcccaaatggcaaactgtgtttcaagaaataaataagcccattctaagatataaaccctattttcatgtttacttagctcttttcttctatatcttctgggattgatatttttagtaatatgaaccagctatttgatgccctttgaaagtaacagccttgctgcatgggtcagttttctggtagcgtatcaccagcaaggacatcacactcaggtagaagaaaaatgaatgttcttttttggaatatttcaaaggttataaatgtatatcaaacaaaccagttttccttaataaatcacctcttaggtctgttttctctaacatctagaacttttgtgaagctgttaagttgcagcctataccaactgttgaccttttgcttatagctttaaaataatgtcttagttatcttacttcatatgaaaagaaaatgttatgagtaagagatttttcccttacctatcaaactgtcttttaaacatgttttaaatatttcaatgaaaatatttctaaagtatttattctcctaacttattaaacagaaggataaaaaccgtaatcagttaaaaaacactcagggtcaccattatgagaatcatttaataaatgatgctctaatgcagcaatgtccttagggctctttgaagtatgaggaactatttgcccctaagctaaatggccccagactgttctgctgcagttgcttctgccttccttttcagctgtcacttctgctgtcattgatttgggttcactctttgaccctttttaacccagtgcagaactgaatgtctagaaatcagacagtagagttggttaaatgtgcaactggagtatttgtgtacaaaataaaggctatgttccagagggtggcttcagtctcctacagtaaatttcacagactttgaatatttcttcttcttcttcttctttttttttttcggcaaacccaaggcttcccttgcttagtgggtcatcccacaatttgaagtaatgtataagcaagccattgctatacttctagggttgtttattgaataaatttagtatatcaataggtgataaaagagacaaccattttaaagcctctccatatgtttgattaaaagaaataatattcctgtctttgcacactgaaccttaatctattttcatttgtcttcataacctcttataaagcaaataattgccctgacctttttatctaacatctgaattttccttatctcatttgtgtgtgtcctttaagattcaatgacaatgcacagtaatgtagataacgtgataatactttctgttgtgtttttagcacgctttgtataaatcatatcctcagggtcccctttattcatatattctacttgcaccacccaccccaagagtcctggtttattagatttttctcctttgccaaaatatttgggttttctctccccccccagcataggccttattttcataaatgtgtagtgatttcacctttcccgtaaagttggccagcctgcttgattatggaaattagatttactggtttctacttcccagggtcccttctagaaccccgcttatgaataggaattacattgacaagcaccagtctcgggcacagtggctgtttgtaaagacagcctacacatgttggccaaaacagtttcacccttgagttacttcaaaactggctggtggataccatctggtcccagtgatttatctactcctggtttgttgattagatgcagggcatcatgtttaccactatttgatctagtacctctgacctgccgagttcagtgttctggtttggaaatgcgcatctccttacaagacaaagaattcattcagtctctccaccatctccattttagccctgtgactgtgattaagtggttcctctaactggcttcctccctttgatagagcaaaagagcctcttactatagcctttgcaatctcttgcaagttgctcctgcctagattttattttgtgtttaacctgctgtgccttacaggattttctctattccttctctggactatttttttttctttaatcaccactgctttttcttctgccttttaaccacaaggaaggttctcttctctctccagtccccaccacctcccccgccaatataagtaattattctggggcgactataagtaagtttttttctttcccctttttaaaccagtctccaggcatcttgagggttgtttactttccgaactccctcagtaatgccctgcttttgtcacagattcttactctaatatagcaaaaactatgtaatggggtttgtacttttcctctcccatcaagttgttaaatttaatattgctgtgtggtcaccagtacacatttgtttatccacacttacttggtgtcctaagtcctatgtactactcaagaccaaggccaggtatctcttgggacctttcttcccttcccccctccatccctcatactcctgttctagaagcacttgttcaggaagtaatcatttttcgtgtctccagatcttggctgtagatcttggcaggtaagtattatgctgatgattttttttttcattcatgtctgtgaatcttcacacacaaatgtaagaggataatggagggaaatctatggtaccaatctaaagctgagtagaggaagacctatttgacagaaatatttaagacataaagagagtataagggaggtgatccggtgataaactgacagacgctctaaggtcgatatactgtcatcagcaacataaaaaaaatcagcacttaaatgcatcacaatggtacagagagctgtcatttccatctttgttctcccttcctttgatgtgatagggagccaactcccttcatctccgggtggaatttttgtttgtttgtttttatttgacatacatttatccttagacagtctaaatttccaaagcatctgcctttatttcatagagcggagagttctttcaacaaaatgattggctattaggaagaaattgatcatttgtcaggatagtgcagcagacacagtgcatattctgggcacacaatatttttgtaaagtcagatgcatatctactcaagcaaatagtgtcttgtcttaatcttttgaattttattcatgagttagatattctaggatgcaaatgaatcatatttatctgtagaaacctttggatattgttgctaagttgattccccaaaatattcagtcagactatgtgaaattgctgatatttgacctatttggcctaaaataatggcactctcataagaatcaacctttaatattttgtttttctttaatctctcaaagctcataacagaaccatttcaaaagctaaagaaaagattctgtagctcataatcctagagcagtattgcaggttgtagcctgaatttttatcaagggactgttttgtctttctgctaaataaagctaaatttccatttggtctgtaatttttagaaataaatatttccaaagactaaaaataatagtaatgataacaatagaaacaacaagaaaacaaacactcccccattggttaaacatagctgaactctgaaacatagaaagaatcccctttctgagaaatatatagcatcttctgatatcagtgttcataataatagctgctattgattgaggtatactgtataattttaatgcttctaacaactctctgaggtaggttctgctcttgtcctccttttacagaagatgaactagtctcagagaagttaggagggtggctcaaaattgcacagttggtaagcaacagaactgagcctaagctgggcatggtgacgtgggcctatcatcccagccaccatgaggtggctcgtgcttgaggtcaggagtttcagactagcccgagcaacacagtgagaccctgtctcttaaaaaacgaaaaaaataccagatgtgatggtgcatacctgtagtcctaactgttcaggaggctgaggtgggaggatcatttgaacacaggagtttgagggtacagtgagctatgatgatgccactgcactccagcgtgggtgacagagacgccatctctaaaaaaaaaaattttttttttttttttgagagagtcttcctctgtcacccaggctggagtgcagtggtgctatcttggttcactgcaccctccacctcccaggctcaggcaattcttctgcctcagcctcccgagtagctggaactacaggcatgcaccactgtgcctggctagtttttgtacttttagtagagacagggttttgccatgttgcccagactggtctcgaactcctggcctcaagtaatccacctgcctcggcctcccaaagtgctgggattacaggcatgacccactgcacctggccctaaaaattatttttttaattaagaaagaacttagcctgaacttgggcttatttacctttgaagctgttatgctttccatataacatgatgcctccctacctcagagactcagaacagagagtccagtcaaaacatttatagctaatttcccacactgttctgacatacatactatacagtatgtagttagatagtaaatcatgctccagacaagcttttctgttctcttgagtttcccacttgttgtgatttatccatttgttttttactgaactgttctgattgaggatccttggtgatgtggagtgtcttagtccatttgtgttgctatgaaggaatacctgaggctgggtaatttataaagaaaagagatttatttggctcatggttctgcaggctgtacaagaagcatattgtcagtatctgcttctggtgagggcctcaggaagcgttcactcatggtggaaggggaaggggagcaggcatcacatggtgagagaggaggtgccaagctctttgccaacagttctctcttaggaactaagtaagaattcactgccaggtgtggtggctcacacctgtaattccagcactttgggaggctgaggtgagtagatcacctgaggtcaggagtttgaaaccagcctggccaacatggtgaaaccctgtctctactaaaaatacaaaaattagtcgggtgtagtggcaggtgtctgtaatcccagctacttgggaggctggggcaggagaatcacttgaacccaggaggtggaggttgcagtgagctgagattgcgccactgcactccagtctgggcgacagagcaagacttcatctctaataaaaaaagaattcgctgctgcgagatccaggccattcactaagtatctgccctccacaatccaaacatctcctgccaggccccacctccaacactggggattagatttcaacatgaaacttgaaggggccatacaaaccatatctatgccatcgcacagaataacctaaaattcttggttcttgaagtgcctgactgttacgccatttttgcatcactataaagacatactggaggctgggtaagttataaagaaaagaggtttaattggctcatggttctgcagtttgtacaagcatggctccagcatctgcttctgatgaggcctcagggagctttcaatcatggtggaagggaaagtaggagacagcatgtcacatggtgatagcgggattaagagagaaagagtggggaggtgccatactctcttaaccaaccaggtctcatgggaactcagagcaagaactcacttttctcccgggggatggtgctaagccattcatgagggatccacccacacaacccagtcacctcccactaggacccatctccaacactgggagtcacttttcaacatgcaatttggatggtgcacacatccaaaacattttcattgacccttcttgttctaagttgctgcttactgctacttactggtggaataaaaagaagtttgggttctgtatgcggtcccaaggctaccaagtgtgtcagtgctgttagaagagttttaaaccaataagcaaaatgcatcatgactatttcttaatataggctcattttgtaatagtgtgttatgtttgtagccacaaatcatggagctatgaaggttcatctcataataacgaaacaatgcttttttataagagtatattttctacttgcccataccaccaagtcattcggccaaatggaagctcagacttggtgctactgagcaccttttcctatgtatatttatgaaactcgagattgaactattgttctttttcaagctcatgcagttctagtatagtcattctgcatgactgaacttaactctagtcaagtaaatttgggttaggttagttggtctttgtactggcctatgttaattgtcatatataaaaaatattaatagaaacactcatgggcaaaaacataagcatgctttctggatagcctggtagaactcattcttatttaggcagttcatttggaaaaatcaggtcttataatgctggacatttaatttggcttcagcctttgaaaggccgttcttccccacattgaaactgatttcagaatatgatttaatgtatgtgctgctgtagcattgcatacaatttaggattatgctgtcttgactcagagttaaaacataagagtagctagattaaaaaaataaaacatggccgggcgcggtggctcacgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaataaataaataaataaataaataaataaaacatgaccttgcatggtttatgatccagtgaaagataaagagaacaaagtgggctgttctctgttctttcatacttctggtactgatactttttaaagtacactacagtgtttactatttcaaaccgataagcacagcactgctgccaagtattatctttaaaacaagaccgacatttaattcagttgtcatatttgttctcatccttgaaggcagtttaaaaaacagttgcctctcattggttactgtgggatcaggaaaaactaggagcttatgtaaatatgcgtgtatctgaaaggagaaggtttatttttttattttcctttgaagtacctttaagtgtactcttaaagtatatcccgaactgcataccattatgtgttttccacataggatgaaacatcctcaaggagaggggctaaaaataagtatattaaagtaacttactctttgctggcagaaggtcctggtacaaaattaggtccttgaattttccaaatgaggttgtatttattgcccttcttttctaagaaaggctattttaataatttttgctatcacatcaaagacttttcatgataattatagtcaataattgcagtagtaatgctgcgtgccatctgcaggctctgtgtaatggaaactagggagaaaaacgtgtccctgtgcttgatgggagttaccacagaacgaaagaccctggtgcctgatcaccacttgcatcagttgtaggtgactctcccactcctgggcccttggtcatatatactgtcttttttttctccctttctcctttgacccatttccttccatttctttttctctcactccttcaggcctctaatgtgcaggagtaagagagaaagaacttccccatcccccatgtttgttgctcatcctaaagtagctgacaggccacattctaggagtagaggagtaattggaacttctttgggatcaagtgtttgaccaaatcaattggtttatgagtgagcagttggcccattaccaaaaagagttagagagggcaagctagacattgaagtaacggaatgagcacccactcacccagttgcaccaggtcagagaaagctgtctgatactttcaatttgtgagcatccggtctcaagcttgtctgtgggccagatttctgaagtgctgatgtttctcttaggtcctgtgacaggcattacattgtatagtaactccaatatcagccccatggaagcaaccctaagttcttacaggctcaaattagagtggctcctatcctttcattcatacccaaagcaaaaatggtaagatgcagccgtttcattcttggttagttctgcagtaaagaagtccaggacacttgcagcgcactttctggagcatttgtatctatctctttggcccagtggtgcctaagagggccctggtatggttagggttatctgaagatgactaggaattgaacaggccttacttgaatgtgtagtaaatgactggtttctctcttttctgtgtcacttgctgacaaagaggcaataacttttccatcttcttctctaaggaagtaaatttttttatgtcataagtagacacattaatactttaatatagcacctaagatctggctttatttttccttccctgtggtacttaagaaaccagaggaaaatggcgggtggctggatggcagcccagttgaagaattggctaatcaataccttgcctttgagttcaggcacctttttatcagggttttttagagcctagaaaaaaacagggattattcctagtgtgtggagaggcactgggtggtatctcaaattgttcgttgttgagtatatatcagtcacttgagggcatagaagctctcctctggtgagacctctactacaaaaattgaacggagctatgccaataatttattgactatccaaatataagtttagggaagcttgttatcaagtgaccaggttagggcctttaaaaatcaaagcactaacattgtctgagttttttttttttttcttaaaaggagatttgaatgtttagtgacttctgatttgtcaaaccaaggaaatgaaacagcatgtgtgtgggaagtctttgttctgccgattttgctttgttgaccaagaaaggcagcagaactaggtccccaaggagttttattcacccttgccttgtcagattttgctctgagtccgagataatgccttcagtagttttggttgtctcaaaaatggacatagtatatatggcaatgtataggttatatctgagtgtgtgactctctcctactttgtccaaaggcacctcctatggcacatctgttgaagttccaaagtgagaagaaacatgggttgagttgatttgcctgatttagcatcatctctcctgtcttttggacttgagttgttccaagataagattagaggacctcagagatcttgtggtggggagggggttggaggaattcacattatagagtaagaaggagagagaaaaagcctagagaacaacaataaaatccatgtctgttcatcttgtaattttcaagagggcggagaccaagccatttgtattttctgcactgatggatggcatctggcacataagagtcacttgataaatactgcattaagcaccaacaatgtttttgtgttgccaaatcgggtcaaaggttagtttgggagaagtgaatcaaatctttgacttagacttggggaaaatgttagggcagagttccattcccagataatctcttgcagtggtctagttgaagtaactagttcacgaagtggtaaatatagtggattttctaatcataatgaataaatcaaatgtagttaattaacaggtctgattctaaaggaaaggttctgaaaggtgagattggagaatcaaatggtgttaagaagccactaggataagtcccagtcagacctggggtgcctcactaataaaggcaagctggtagagtctataataaaggctgaggacattgaaaacttaagcaaactcagtcttccaggaaaggcaacttcgttaaataaggggaatctgtgctttgctagtgaccttgtgtttctcaggtggctaatgcatatgtagagaatggaaaaccattgcacgtgatctatttaggttttcaaaaagctttcttggtggcggggggcagttgatgggggggttcacaccaagccaaggaaactcaaagtaactggcacaccatggaattgtgggactgtttcgtcaaatattatgattgactttgaggcaggaaacaaagggtaagggataaacacaggtaattctctgaatagcaacatagtggctttcactccaaaattaggactgagacaagttttacttaaagctccaggaactgacctggaagaggaagtacacattgaaatctttacatttgtcaacaaaacttttctaaataacaaagagcctattaaatggtaataaattgtagggcatgtggcccaggtgctagggctttagataatgggtgaggaggagtttttgtttttgttttgcttttactgaaaatggcatgcttcatattgcataacatgctgcttgaagacttcatggccagttgccagggttggggaaactcagccttgcaaaacgatggggagtatgaggagggctctgcctctccctcatctgcccattccaaggttcagaagaatttttctctcatgttataaaattaacccctggtcaactgtggctcatgtccatatccataggaactgggacttattaacagtccttcagtgcagatctgtatcagagtaagccgtaacttaactatgacttttagcaagaattttgtgaagtgggttttaaaggatgtaattaagcacagacattaaaaatgtaaatcttactttcctctgcaccattttattgatgcctagctagaattttgaggaatggtttgcatggatcactgttttttgttttttgttgttgttgtttgtttgttttgttttgtttgcagaatgaaacattcccccccaccccactccaaggcttgagtgcagtggcatgatcatggctcactacagcctcagcctcctgggctcaggcgattctcccacctcagcctgcctgactagctgggactacaggtgtgcgccaccatgcctggctaatttttaaattttttgtagagacacggtctcactatgttgcccacgctgatcttgaattcatgggctgaagcgatcctcccactttgacctcccaaagtgctaggattacaggcatgagccactgtgcccatcccagaatcatttttctttatgtgaggaagtggactttgccattggtgggtttacataaaggctttctagatagccatttggagaaatatcttttggagaattaatgatgaatgaatatgttattcttctggtatattttttctagacagtaaatttactgaaaacctcttaccacgctgtattttgaggggagaaattttgggtatattgtgaaaaggagggttaagagaagctaaagacagcttttaccttcccttttgtttaagctgaaagcaattactaaaaaagagaaaataatttgatgttaaaaattgtcatgactcagccgagtgcagtggctcatgcctgtaatctcagcactttgggaggctgagggggaggattgcatgagccaggagttcgagaccagcctgggcaatgtagtgaaaccccatctctacaaaaaatacaaaaattaaccgggtgtggtatcacatccctgtagtcccagctactcgagaggctgaggtgggaagatcacttgagcccaggaggtcgagactgcagtgagctatgttcacgccactgcgctccatcctgggtgacaaagcgagaccctgtgtctcaacaacaacaacaaattgttatgactcacacaatccatgaaatgtacgtaagaaggcagactttaatcattcaattagagcaggtgtctgaaatgtctgatatctgtgagcctccccactcaccaactgtattttcttctacacttgcagcaaattcagctgttaaccatttcggatattcctgtgaattctaaatggctgtggcaggctatctgagaatgagattcccaggatcttctttagagattatttggaaataatatggaaaatcatctgctgttggaagtcagtgttgattcagcccctaggggaggaggaaaggggtgtgtctgatgtcttcctgaggataccttcttccttttgctttctccgaggtcttctgtgatggtgtgcaggagactgcccactggggcagtcactggagatgcaaagaaagggcaaagtgctggcggctagccctcccctactctgagaatcaccatgaccttccaagccaggtctgatcagctgtctcagagatggccctgctaaggccttggtctaccagctattatgatgtgtggcttggggatacaggttccagagggaaaaaaagtcctcaccaatggcgttttctgtctaggctgctttttattcatagctgaatgtatcactggggctctaacagacgtgatcaaccctgggaatctcagtctccatacagtctctcatctcactctctgtaaaaagaaaacctcagagttaggggagtgggagtatgagaaaaattcaccaataaaacaagaaggactttgaggagagttgtggaaatcttaatttcataggcactatgtaacaaacaccttcaaagtctgtgtatttgtttttctcttaaagagcttgaaactcacatgtgactccttcatatcacttgaatgagtatgaaatccgtagaggcatttggaatcatttatttatccctaggccttctgttaaattatgagcctagtgaaaatcataattgctacttaagagaaattctcaaacgatgctaccaagatatgtgcacctgaattattgacagaaaagatctcctttgttagttgcaaaacaagtaagagagctccatcttttcctgtctgctccttgctatcccgcaaggtcccccagcacacttctgtgagccttttattagcactgcttagaaagtatttacaggagcctcagaatttttggagagttttgggttaatcactagtagtattactattccttttgagtcctggaggtagtggttgtaaatgtgcaaaatagatgcagttgcttcagctgctcagaagtgatggcaacacaaggtcaaagtgtgcatttcaggccattcactcagtttggtttggtgtgccttaataaacctttggtatagttaaaatggggatctaagattgtcagatattaaccttggttgacaatttgcttatcatttgaaaagcagtaagaagccttggttgatttctgtctggagtgcagtttaaagctattataagctcattgaaatgaagtgtagagttttaaagtagcaaccctaactcttccaactacacttacataaagttattcttagaaaaatataataaaactgattattgaatgtatgtgtttctgactggccttctctatactaccttgcaggattagtggacctagaaataattggcagtcttaagccctccagagctatattttggcaaggttttgcaaaatgctaactggctgcatttctcctactgattagtaggtgatctcaaatcatacatctgcataatgactgtaatttacgtgctttgttattaaggtcagatgactccaggctttggatgcacatagcacattttatgcagtaatttcactcctttttggaaggagggaggatggattaatgtacacgtccccccacctccctggagttattaaaaacctttagagattttctttctttgttcccatgaagcagagcattgtatgttcctcatggggtcttaggtagcttagaggggctggagttatatagcaacctgcattttagttcactttgtggctacatgaatttagatctaagaaatgaacagaaactattttggtaatgctttagaccaacagcaaggaattattttacgtttagaacaataaaaattagaaaaagagtaaagtagcaattgagggattaggaaaattgctccagcaaataatagcttaatacagctccccaatattagaattacatcaagtatttatatttttgaaagcatgatgaaagtttttccccgctggccacatgtatttatgctttttaatttgaaagccaagacttgcttttcttaaaaaaaaaaaaaaaaaaaaaaaaaaaaaaaacttctaatagaagagttttagatttacagaagttgggaagatagcacatagactttcctatatctcacccccagtatcccgttattaacatcttacattagggtgggtatatttctcatgattgatgaaccaatattgatgcataattacgaactaaagcctacacttaattctgatttcctgagttttttggtaactgtcttattgggatatagttaatataacaaataattcacctatttgaagtgtacagtgacttttagtatatctacaaggttgtacctccatcaccaaaatcaatttttcatcacccccgaaagaaaccccgtaccttttagctggcatcctcactttcattctttcccctctcccccagccctgggcaaccaagaatctacattctatctctagatttgcttatgctggacattttatataaatgtggatttttttcacttagcagtgtttttgagattcatccatgttgtaacatgtatccgaatttccttccttccaatggctgagtaatattctatttacagatacagtagaccacattttgtttatccattcatttgctgatggaaatttggctattatgaataatgctgctatgaacatttgcatacacctttttgtttgatttccttagtttttttccccacaatgtacttattctgttccaggatcccatccaggatatcacattatatttcctcatcatgtctccttaagctcctgtggcttcgcttttgatggccctttgaatcccttggttgatggcttggtcaccatcagttcaccatcacatatgcatgccgttcagctccttgatgtgccctatttccacatctttctgaactagctagaaaagaaaagtttgttaaaagaaaaactttggacatgaggcaggagaatagggtctggaggcagggaacctgaggctgattcatgctgacttcctataactaaattgaaaggaaaaccccaactttccacgcttaagtgacaaaaggaccagaggctacttcctttgcaacaccatgccccgccccgccttccccctttttctgcatggcaggaggaaaattgaaagtacctctgattggttgctttcccaatcagacatttgcataggagtgtaactttgtaacttcattttagcctctgattgcaggccactacttcatttgcatggggtaaacaccaagtggccaatagaaacctctagggggtatttggaccccagaagattctgtaactggggcccatgagccactgcttggttggctcccaccctgtggagtgtactttaattttctgtaaatctctgcttttgttgtttcattctttccttgctttgctgtgcattttgtccaattatttgttcaaaacaccaagaacctggacaacttgcagtcaagaccctctactggtaacagacaaattaattttaacagaatttaactgagcaaagaatgatttgcaaattgatcacccctccccacaaccagaatatgttcagagggattccagtactgccatgtagttggagaggatttatggacagaaaaggaaaagtgatgtacaggaaacggaagtgaggtacagaaacagctgagttggttacagctcagtgatttccttatttgaacatggtttgaaccgttggccacctgtgattggtgcaagagcaagttacagtctgtttacacacccagtttaggttacagttcactgtgtacggggaaacctttaaaccaaactttaaatgtgtaaggaggcagctttaggctgaacttaacaaggtgctgcttttctggcgcccctccctcacctagtacaagttgtcagaaatggttcttaacacgaaacttcagtagcttatcagagcataagagatgttcatttctttctttgttttgcaattgtactgtcttacatttacataatgcctccttgttttcaaagggcttttttcgttttaaggttccagtggataactgactttcccaagagtctttaccaaaagcttcccaatcatgtagagctgggcttcaaacccatattcctgacttctagataaaacttaattatccctagactgctgctgttatctctgcagaataaaagaaccaagtagttttaaatatttggaaccttttaaattcactccttaaaaaaaccccttgtaaagagctaagttttcttcataactcaagtgaggcactcttctagaaaggccaatgcaaaatcatagtctcttatgtttgcagttttcatagtgctttccagtctgttcttctcaaatgttcctcactgcggtccttacccttaaggaacagtttgtctctcttatttaccataggcatttggttgctttattggtaaaattagtccgagtaccaagagtgtctgccttaaaaatcccactggtgcaggcaaagcctgggttctctaccagtgtcttgcaatgttttctggctctgttttctccatttaggacactgggggagtaaacactagagattttctttatttcccgcaggtacagaaagaaagctgacccctaagtggtaactaccggtattcctctattactgccccacctcccaaaaaagtggggagaattggagagacactttcttggcatctagttggatttctaaatgtattttctgagagagatatagaaaatggttgttagacatagttgaaaatagtcaccgggcgtggtggctcacacctgtaatcccagcactttgggaggctgaggcgggcagattacctgaggttgggagtttgaggccagcctgaccaacagggagaaaccccgtctctactaaaaataaaaaattagccgggtgtggtggcgcatgcctgtaatcctagctactcaagaggctgaggcaggagaattgcttgaacccgggaggcagaggttgcggtgagctgagatcacgccattgcactccagcctgggcaacaggagcgaaactccatcaaaaaaaaaaaaaaaaaaaaaaaaaaaaaaaaaaaaaaaaaaaaaaaaaaaaaccagaaagaaagaaagaaaataaagaaagaaagaaagagaaaatagtcaagttagtagtaaataagctgagggctggcctgagcacctatctaccatttataacattttctatgggaagctgagttatgagcaactgaaaataaacgaacattagccgcaccccatttgtacatcagaggcagcctttggtgagaggagtaaatgagataaaatgagaaagcacagtttcacagattgcctcagagcgctgttaaatgatggaatagattcctcatattcaatgcctacttctttaaccattgatttgaagtgcctcaaaaaaaaagaaccaatacacactcagcaggattgagagtaatttattgtgattgtctttgttcagctttgaaaactaaggcattgatattaagactaaagagaaattacatagagctggtgtgattgaaaaaagtttggctctttcgagtgattttttttgttttgtttttaatgccagagagttaagctttaaaagcacgcttcattgaatcccatccaagcctcctaggacagggctgggggaccttttttctattgagggccactgacccacaaagaaaaaaactaatcaagggccatgtacaaaaagcaacttaatttaggtgcttccttggaaaaccataaagcattgaattcacctgctttttaaattaagaacaaggaattctcaacaagtacaacaaataaaaaaacccttcagtttcatattatgcaccacttaagaggtggggtgggataagagagaactacatggttagagtgaaaagagagtggaaagcagacaggagagtcttaatggactagaagcgatacatgaagaagaaactgtatgtcaagagccatggaagcaggagattgaattagggaaataggggagagaaatggcagttgtagatcataatctactattcactaaggtagtagactaactggttaactgctatactcagctgttccacagctggaattcagaagcctttctgacaacaattcttaaggaagggtcagaatcacctagagcccttgttaaaaagtgcaagtgtccaatgctacccccacagtggctgtctacctgtcccatctttattctgttgtcctcgtgttcagctctctcagcctaaaggaaaaattgtggcatctttcttcagtgagaagaatataagatcaccgggcttagaaaggaaatctccagaaagaaaagatttctcactcaggcacagcattttagaagcagtctcaaacacataagacagaatgcctttcaaataatatgcacgccctagccttcaaaataaaccattttgggtgcttaaagtagaaatattcaagttaaaaaaaaaaacttaattagttgctcaagtcttcaaagattttttaccagaacatggagctataatttcattttcaaatgtacccagacttgtcctccttttcctccctgtgcttctcattagcactaactagttgtggcaccgaatccccagtagcccaagaatgtcttggggtttaattcacaagtgtgtcttggactacgtgtgtcacagggcttttggcaagaatgtcaaattacattttcaagtaacgctttttagaaatgcagacaggataagtggtgcattcggggctatatggcccaaagtgtgaactttgcactgaggggcagacgactttgccagcagaaacattagccaagtatctaccctgttgttgtcctttacataaggcaagcctttcaccattagacaaaatcttcccggaaagatctctctgagatgaaagtgcactatttttttctttttaaaattagatattgcaggccgggcatggtggctcgcgcctgtaatcccagcactttgggaggccgaggcgggtggatcacctgaggtcaggagttcgagaccagcctagccaacatggtgaaaccctgtctttactaaaagtacaaaaattagccaggcatggtggtgcacgcctgtaatcccagttacttgggaggctgaggcacgagaatcccttgaacccaggaggcggaggttgcattgagccgagatcacgacactgcactccagcctgggcagtagagtgagactctgtctcaaaaaaaaaaaaaaaaaaaaaatagtgccaaaacaaagacgtgccccagtgttccagtatcagcaagtctcgataaggttctgcttgagggtcactggtggagatgagatgggtggagtgcatgggccactctgggccttttatgtgtggcagtgtaaatggtgccatccactcggaccaggttactaggaaaacttttattgctgctacccgtttttgaagggtgtatccttagtataaattccctgtgggtgagtttaaacctgtcaacatctagcaccttcttcaacagagaaaattattatttcctgctgtctcttagtattttcttgctttgaggtgtatgtgtgtgtgtacgcatgtgtttgtgcatgtacccatgtacactgggggcagggaaaaatgatgggtacttttctgtgaacttagaaacctattttgataggatccagtaagtgaccctttattaggtgtgaaccctgttaacattaggtgagtatagtttattttccaaactgacaagttattttgccttgaaaattcatgcataccacaatggaatctttgcaggtgcttgaaaaaacagcctatcctatgatgaattttagcttatagcaatctttaaaaattttatttaaagtctttattatgaagtaattcatttaaatcaccctatgtgggttctcattctgagcattccaattcattttctacagggggtatgaatataatatgtattatttaatatagtgacagcactgtactatttgggggccttcatattgttttatgtgtttagattgtaatggagggaacccttacctcaacactgaaaccaggagacaactgaatctttctgtgttaattatgtgtcccagtaccgaaggcctgctgtgaacttgttaagccagtgaagagggagttttgtttttggttgtaacaaaggtgtttccataaaaccgagccttagcaacccctcttctgtcactaatgagatctaagatattctgcagactcacagctctaaacttgattacacaaccttttttttcccttttttttctgttagtagaattatttattgaccaaggttttcagaaatgccaaaataaacttttagcagtttctggatgaggaagttatttgaagattgttgctctttctgccttccttacatggtcctttaatgctgcatactccccttttttgggggcactaacattctccctactttttaactgccaggaaggaagaatgatcgggaacatatatgattatataattatttgcatatgtgcagttgacaatctagtgttagtcaaataaattgccagctcaattttatctgaaataccctgctaccctaaagctgctttgatatctccattaggtgaagccctatttcctgtaagtacacatggccaagaagcagcaatggccagctcatggaccatttcgttttccatgattagtgttgtttgaatgattagcttttaattccccatccctttgttgattggtcacacttaccattgacaggttcacatgtcttcagtatactcattcctgagttcctcagatcatctctcttttcagaccccttttgacttgcatagaacatggacagcaatagcagaaggaacagtgagagtcaatccttgtaaacgtgtacaaaattataccacaccaattaatattggagagactgaagtgatagtagctagtggggtttatttttgagtggcattgcatcttgtggtcattataagagaagagacatcgtctcttcaaagcacaattttgttctgtgacagaggagaacaagggggggaactctggggcatatagaaaaaaccccccgcccaaccctcacctccaaactgcaagccaaatgcagttggtataagggagggagatacttcgtgggttgggttgctgtggagtgatgtgtctttgacatttcccttgactcttggggctgcatcactacataaaggtgtttattggaagttgttggtctatactgagatgatgctacatacacagaatcatagggtagatatagtctctgacatctgcacagaatacattggataaaaaaaatcttaaactcaaggattgaggattaccatcacccctttgtgatttatcataggctcagattatccagcataaacccctatagtttcctctttgctggcaacccttgaaatgcacaaatccctttgtttccccacagtgtaactattgcacatgtatttgctcagtttttggctgttgtcacatattttataaaccattcgtcattaaggacagtctctcttggagtgtaaactcccaaatctggaaaaactgtgtctcgtttgcatgacttctgcagtatttagcatagaatatgagaatctctgggaatttataaaagagactttagttgacatggaatattatattgtttattgactacaccagttttcctgttggtttagccatctctctgattggaaagttcttttgctttttggagagggctttattattttattttctcaaaaagggaatgaatatttttagacttcctggaacttgttagatacacatgttgcctgggcctttgcaggagcctcacaggttgaaatgaacctaaatcaaacctttccctcttggacttcatgaatgatgatagacattgactgtcttactttttatcttgcaggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatggtatgttattcaagtcatatgtaagaaccggcagttaggtctgtactgtagctttttcacagctcctctgctccctcagtgcttaagttttctcccaagatgttgtccttgttggataccagagacgagtttaccctgtagctttatggctagaatacttccggatgcactggaatctgtatggtaggcattatggaaatatggtcacaaggagacaaaaaatagattagtttaacttaaatgctttgatttattttcttgggtgaacacagaatagtgttgttgacgcaagtccctttaaaaaaaaaaagacctcataataaaaagcaggcatctgaaaactgtcttagtcaaaataaagagaatttacagatgctggacttcaaattaaatttcaaaatggatccccaaagacaactagaattcctaaaagttttgcagaacacaggcaggattaaagttcttgagtttccatgcagcagagacccaaaagtagccattttactatagtcttcattaagctgggctccatccaacctcacattagctgaagctctggcatagtctttccatgtaaaagccacgacagaacccattctaatcacctatgccagacgtggcttcttgcaggcacactttctcttaatattgaagaaatagccaatatgagccaattgaaagtgtactttgatcctatctgaacaatggtacagataacagactttaaaaaatagaatatggagtccaaaacacctcaggattcttttccctggtgctgttcactcagtttgaagatttttatgaagtagatttagttttaagaggattgatttcctttgtgcctgttttaaaggccattctaattacatagtacctttgaagcatgcttttcttgacattatgtgtggtgaagaagtacaagacaaattttctagatatgaaatgtctttgagtatttctgcaaagggcttgttaccatggtgagaaagttagactaaattagatttgatatagctgataaggcagtcctcagttaaagaacaggttgtatttcaaatgttggctttgagatgtgttatttcaaacttataaccaatttaataagtgttaggttcccaggtgagaccacaaaagcatatttaatctataatgtagttgaactaaaacactgtctatgtagtatgccgttgatcctacccattttttcaaacacgctatgtgcaaaattatgtcttagttctatcacctttccctggatgaatgggaacaatttatatatctgtatatccttcttattacccatatccccctacatatatgctgtagctgttaaaagtatttaacaatatgttaataccatgtgaaaatgggtgttattggcaaaatctatcattagacctcctctgtctctcctgatcactgaattattattattgaaaagaatggtgttttcctgaccatggcatttctcattcaagataataacctaagccttttcttttactttggggagaaaacttagaaagctaattaaatggtcatttttgaaaacttaagatgttgatatttaaaaatcaccacttaggggcttcataatggaatttagaaggaaaaaaaaatctgctctttagaaatgactctcccgttggcagcacaatgtagtggagataaagttgtttccaagttccaaggccttctactgcaagtcacctcatttcttgttagacttgtatcttcctggcagggagcccacagtcattgcctatgggcctactggtttagctattcttttcccttctcgctccccatggttttatagcactactatgattccaatgtgtagtgttttgttgttgttgttgttttcttcttaaaccatacagagaaactttatcagtaagtgttaacatgtgttttttaaaaaggatagaaagtttttcttgctcttccctaccaggcttcacattcaataaatatgttaacactgtgccttgatcagtttcaaaactttaatgattatgaaactccagtgttttttctgacttcaaattaaaatatggcataggctgggcatggtggttcatgcctgtaatcccagcactttgggaggccacggcgggcagattgcttgagcccaggagttcgagaccagcctgagcaatgtggtgaaaccctgtctctactaaaaatatgaaaattagccaggagtggtggtgtgcgcctatggtcccagctacttgagaggttgaggtgagaggatcacttgagcctgggagttcaaggctgcagtgagccaagattgcgccactgcactccagcctaggcaacagaacaagaccctgtctcaaaacaaataaataaaataatataatataacataaaatatggcatagacaataaagttagggaacatagatacaaggtttttttttaatgggtagtagctgaaatgtacttgatctggagatcaatatactggaatgctggaatactggaatgccagaatactttgcacattttctccatgttaggttacagaaacaatgagataattttatatggtaaaaccttagttgactggtacccaccaaatcatagtcccctagtgggtgctgcattgattgattaattttttgtttgtttgttttgagatggagccttgctctgttgtccaggctggagtgcagtggcgcaatctcggctcactgcaacctctgcctcctgggttcaagcgattctcctgtctcagcctcccaagtagctgggattacaggaacacaccaccacgcccagctaatttttgtatttttagtagagacggggtttcaccatgttggccaggctagtctcgaactcctgacctcaggtgatccgcccacctcagcctcccaaagtgctgggattacaggcatgagccaccgcgcctggcgatgattgactaatttttaaggctgtcaattaggacttgccagtaattctcaatgcctgccgatccaagggcattgattaacaggctataggatatgtcttgactctcagaaattcaagggtggatgctttggccaaagaattatccaaactattataatagctaaaccctggctcttggtgtgaattgaagagagaaagttgggcagactaaaaagatggtggtagggaaccaagatggagcagtgaagttgcacagagacagctggggacatatagtaaggaaatagtaaaaggacacatggaaatattatgggtcaggcaacttcaagggagtaccttttgtcatctgcaagcttacagtgtaaattcaaagtggtgaccttgaccccagacaactttgtctatcatcaaaacctgtctatgtctatgagataccacttctttctaaggtagaaataattacttttaaagtaattattgaaaaaaaaccttttcaacaaaaataaagtttgggggcttgtagagagttagccttctgttaccagaaatcatctcattatcccagttttccatcattcttcctcaattgaccctggtcagggttctagtgccagttctgacatttttatagtcattggatttgagagatgagtcccttctccagttcccttacctctaaggcccttttttattctgtacttttaatttcctatcgtttgcacatctcaagagactgtacggtctatatcagtttttaagatataaactcgtgtgtgtgcgtgtgtgtgtgtgtatgtgtgtgtgtgttcggatttgggtgacgtacaagagaacacttcctccccctcaaaaatcatcagatttcttatattttaaatctatatcactgagtttaaagactggcctctgtgtttttctatgctatcattttttaaacccactttttaacttaggatgtttaataccagaaatctgtattctgctggagacatagagccagattgtggtagtgacagagctagctgctccccctcttggccaattctgggaattttttgatagtagagctgctaattaacttagctgaatcagtcatctcatgaatatgctaatcacatacttaattcaggagggagttagggaaaattgcttggcaaagggaatagaaatagaagtggggcataatccgtgttttgggaccacagcataaagacccgcccccaaatgcctggcattttgtgagaaaatagttgtttttaaaagaagcatagttaaaatcccaaataggttaaggtgattacagctgccatgttaaatgtatttctgaattacatagtaaaaatgatgttacagctatgaagtaatgtcattgctacataactgcctgtatcaaactgtagatattctgcatgtttaaataactaaggaaatggttgttgtctgatgctagtctattgggaaaactcctttaatttgtcattttcagagcaaatttaataactttggatgggaggcagtgcacagtgaattatcatcctagttctgcagtgaacccactgtgactgtgacctggggcaattaaatgagtctcagttttcccatccataaaatgagggggttgagctagatgctctctaaaacccttttcaatcctaccaattctgtgaatcttttaaacatgtgactagaccagctgctttagtgaaaggccttacaagatgttaattagccgtctgtatggtaccctctattttccctctatcattttttaactctcagctactttcaccaggtctttgaaaaaccctcccatgagcctgaagcttgttaacttgaataatagtagaaattttctgaattagcttaaaatgcacacaaaagaaataattgtctgtcccatctatctgcatgggccaagtgtaaaccaagcagttacccttcccttaagccctaaggccccttgtttcctatcacttcacagaggcagggcacgaagcactcttcagacttagcagaatctgcattttaatcaccaactgcaaattttctgtagttcatattagccattaaccagtgcagaggatcagtgagtaggaggcattaaaatttatatgcccgtgaaaggcatgacctcagtggaagcgagctatctgctaaccttaaaagacaaatatgtccagataagcttcatggccattgactaagctgaaatttctggaattttcctgacccctgactttaactattttctacctatatagataattgtcgtttatatagccacacttactaaagatcccctgagagggttttacattggaaaaagtctaaaacaccctcaaagtaagtgtgtcatagatatgcatagcataatatacaacattgattggtttttaatcctcacctcacatttcattaagacattaaaaaaatcattgctttctaaaacctctgctgtagtacagcgggcaacatttcataggctgagtagcctcgaaagtacggagaaagacatgaggccttctggccttcctgcaaatgcagtgtttcttccagattatgccagtggtctccgatttagtttgaaagcactgctactctttcctttatgattctattttcttttctttccatatgaaagagactaaaaagccagctacttttgctaattcttttataatctctctgtgaaacttgaccagaatgagccactgccagcttactgtaatcaaatcaaaagctcagacaaaatgcacacatttctctattgacaaaggttttctgccttttgagttgttatctgaagtgtgaccaattgtgactttagcattggctatctcatcggattgaaaatgcatgtgcagctttacgagcccaaagcactttaactttgggcctctcctcttagctttgacttcttcagaaggcatgacatcagcaagaagcaatggatctgtctggagggaagtaaatacatagaagagcttcagatgaactgcttttatcaactctgttggttcattgctctttgggcctgggagtttggaatgttgttcatcactgcctgctctacttctatgtgtctgtctgtccaggcaaagaacagggcttagttgatctagcactgactccaaccgattgattgagagaattccctgtgcaggcaggcttcagccctttcttgttcattgtccacacccatcttcatcaccctctctcgaaagaattagcagagcaatggaaactcttgtaataaatatgactctaacagcaaggatggtacatggacacaccctttctgcagatagatttggcagtgtgtcagcagttttgaatatgttcatactcattgatttagtaattccacttctggatgtgcatcccaaggaaagaaagatctgcataaacacttatgtacgatgttaataggatgttcatcacagcattatttctagtggtaggaaattggaaataagcttgcatgccccacaatgattacactattctccgtccatgtggtgtcattgtatgcagccattaaaaatgatggttctgctgggtgcagtggctcacgcctgtcatcctagcagtttgggaggccaaaatgggtggatcacttgaggtcaggagtttgagacgagcctggccaacatggtgaaacaccatctctactaaaatacaaaaattagccagatgtggtggtgcacgcctgtaatcccagctactcgggaggctgaggcaggagactcacttgaaccagagaggtggagattgcagtgatttgagattgcaccactgcactccagcctgggtgacagagcaagactctgtctcgaaaaaaaaaatgatgcttctgaagaagttttaatcacatagaaaatgctaaccatatagtgttacataagaacacggtgtaaatacattttatttcaaccacgtagcaacatgtatttcataggaaaaagggaggaaggaaatttgataagccattgttactgtcttttagcagtggggattatatttatattttcttcttacctgtccatatttttcaagttgctataatgaggaatactatttaggaaaaaattatatatttctttatgaaaaatatggaaactgctttggtgaagttttaaaataatgtttttctttttattaagtattacagtgctcactgtagaaaatttggaaaagtagaaaaatacatcaaatcctccagtggttaaatagaatgaagggaataaagggaaatagttacttttgaaagcatgaaggtatatcacttttctgattataaaatgtcactgaaatatctgggggaacaaaatcaagaaagatagaatgaaaaaaattacccttgatccccagcacccaaccgtcactcttgtatttacctaatctttttgtgtacgtagataatgcatatacatacatgcaaattggtatcataatgatttgctatttcatgttctgaattttttttttttttttagacagtctcactctgttggccaggctggagtgcagtggctcaatcttggctcacttcaaccacttcaagtgattctcatgcctcagcctcccaagtagctgtgattaaaggctcatgccaccacacctggctaatttttgtatttttagtagagacagagtttcaccatattggtcaggctggtctcgaactcctgacctcaggtgatctgcccaccttggcctctcaaagtgctgggatgacaggcgtgagccactgtgcctggcctgatttttctcttgacattagattattaacagatagactctattatgagatgtgtgtttgaagctatatggtacctctctgactgatccacatagaggttagtacatggaacacttgcaatggctcctccagctccctagcttacttatacgtgtctgaaaccttctctgggcatttccgaatgcacagaactctgggcatgctaaagccaattgcctagctggtactgagagtgcccttagtagaaatggaatgatgcccagcaaaagggaccttacaatactgagcctgtgtccctggccacattagccaaagatgggggccatcagtaaacattgtatttattcccttggagccttagcattcaaaatgtgttcacgaataaaagcaactttgggaagaaaggctgatcttattttggcagaatcccctagtactctgtgatatgctaatagctcctaataagagctacagctggtgattggcctgtccaccaaggagcagcctgttttttgtttgtttgtttgttcgtttgtttgttttgcttagacttagggtctcactctgttgcccaggctggagtgcagtggtgtaatcatagctcactgcagcctgaactcctgggcttaagcgattctcccatctcagcctccctagtagctaggactacaggcatgcagcaccatgcctggctaagtttttaaatttttgtagagatggggtctcacttttcagggtagtctaaaactcctagcttcaagcagtcctcccgccttgggctcctaaagttttgggattacaggtgtgagctgctgcacctggccaaggagcagcatattgatttgctatcaattgataaacataagttgagtatatgatcttttggtacactagccttagcaggtactctttagaagagtgagattatgccgtgctcgagaaaaaaatgcctgtttaaaaaaacaaacaaaaaaacatatgcagactttatcaaaaaagcaaaacaggaggagatagtgataaatcaaatttcaggttgtcagtaaaatgcttgatgcttttcctttttttccttacatttttatatgcttatgtttgctgttcttcattaattacttgatcttaggtgaaagagtcgatgggtgtaactctttaaattttcttagaagtttgaaaggtatgatttgtagcatttacaaggaggcttcttttttcagcacttctgttgatctagtaacttaatgtttgcatgccacaccaggggtatgaaatacagcatttatagtaagagaaaaatcaatccttatatgtaaaaggcagcttcctaataatgtaaataccaggtggtaatttatagcaccaaaaaaaatggatcaaatgaaaagggccccaatctcttaaggttatgggttaattctagaatgcattaatcaatagccagttgattgtttataaaggagtaactaatgtggcatttagtagcagaactggaggttctttggcctatttcaagaattttgaatgtttatttgatgcaagacaagtagctggggatagaagttccagaagtacatggtgttcttctcttttttaaaagacaggatatttacatagaaaacatttatatggaaaagttttgtcttttcactctagtttttcccatgttaaattagtactacttgcatttagaatgattagattttagaactggaaagtacttacacttccctagctcaatccttataccaagtggacttctggcaaagaaggtagtatgcaaatgaaatacatgggtggggggtgtcgacctgctgatttattcttattttttatatgtgtgtggtgtgtgtatggtattctcttgtttaatgtaatgtaagctctcttctcaagggtgaggtttccccattccctatttttcacccagcagtcactcccaccctcatagatgtctgggacgtttcacaacctttaaaggtagaaccattaagcatttcccttaggataaacagttcccaattttataaggccttgcgtcttcttagaagacctccagcagctttggcttcatttatgtcccctcagatggataatgtttgactccactaggaaagataaaaaccagtctttaaagattttttttaaaggattgtagatacaaagaaactctaagagtgacaacactatcatctcacatattagtaataatgtttatttgttgagcatctactttatgccaagcattatccatatgaggtgagtgataatagccccattttatggatgggataaaagaggctcagagagattaggccttttgcccaagcaaggtcatacagtccccaaatgagagatctcctgtttttcccactgtgtcctcctgctttagattcatagcatgttacagtgtttatttccatcctgtgttgagtggccattcatgagctcaaggagtagcagctgctttatctttagaatgtatatacttaagccttcaaactgaaaattgaaggggaaataaacgctgatcacagacactatatttcaaatccttgcaaaccaccacctctcaaactttctttcagacaccagtagctttacttaaaacagattccctgagcagcatttttacatgaatacaagcaattgctgcacagatctaacttccaatttgcttggcttttgatcgttgtggaatcctggtttacattgctcttggctggttctctcttagtcaccaagtgtattgtaattagtttcaggcataatgattatgagcaatgattgctaggtgtctagggcctgtacagctcttcttcagcagttaagatctgaccctgattctgagttctgagaatgattgaaaaaaaaatggagatgaacattgcagcgattactgaagttgctattgatggctgtggaccaggatctgaatggctaatttatgcttcattcctcattgtagaagtaaatgtcatgggaatagaaaggaggattggggatgtgaaagaattatgcaagaacatgcgagctgctagtttaataggaggaacagatgcaaaaggattttttctccttctttctaatagcaaattattatgctttggttgatattgtacccaattgctatggattttagaatttaaatgatgtctgccatccttatgaggtccctttgaggcaaaaggcataggtagaatagtcccaagcaacagggctagtaagaatccatctaaaaagaaatgagtctgggtcttctggatcccctgatttttgtctggttgactctcatagattaaatatatgaatatttaggaactttttgtatgtagtgagggattaacaattttatagatgtttaaaaaaatctctggtattctcataaaaccgtatgtggagagtggcagtgtatggtaaaggtgaattggatgggggaaatttgtcttaccagaaattttcattatggtctgattgtgcaagaagaaggttaagatgcatggcaaaacaccatgtgctttgatttgagcccataagagccactcagtacatacttgtcaaattgcatacccatttggagaaattatgacgttttaactcattattatcagttttatagaatttctcaagcatttattaaccatatgctcacccaaatggtcttcatatttgcaacttatatagccacattaaagagtcttttaaaatgtgaaggaaagaaaataaattttctgaatgatgaaatgaattaggatttagtatgtatatagcaccaacctaggctcttaaagtacacgctagcataaacacacacacacacacacacacacacacacacacacacacacacacacactttcctggacagaatgtgagtcatggaaaccaaagtatggtccatggtgggtgtcggacaggggcatgtcagtttcaaatcattctcctcttcattaggccatttctcttgtactccaaagtagctatgttatatatggctgcatccacccataagctcttgacctgaatgaggaactccaagattgataatattttactttttctgtaaagtgttcagtgatttagtgtttgtttgacttgcagcactttgtcaaaaggctaaactttgacatttattagaagttttaaattaaaactaagcttgaaatgtcacaccgcacctcgccccacccctaaaaaccaacatgactctaggtgacgttccttaaaaatgcaagtgagttttgagaattacttactaaatgagtctgaaagcacaactcaaataattctgaatgtccaatttctgctgatatgtgccaattttatgagcaatataataaaaattcaatataaggaaggacatgtggtagctgttggaatccactctttttggtcatgaaatattaatagcactggattgacacacaaggcttgcatattgttctcaatgatggcaaagctttgtttttccaatatgtgatagctatgtgtgcaacacactggtcatataataacgcaatccacgtgtgccttttatgccctccatgagcaatcaccacttggcaaggatgctagcaaaattcaagcatggtgtgggacatggaccagatgacatttaaggtcccttctcaactttgaactctagaaaagtactgcatacatttaatcatctatgttaacacttagttgagagagttccacacaagaaaatttgtccccaagacaataaaaaagtcattcctaggaatgcaataaatttatttaaaaacacaattcattggaaagacattttctcttaattaaaacattaatgcttgtcctgactgcttcatactcaacacagcccctgagttgttggtgattgcaactgataggtgaaatgggagaagtttcagcagctagagcagttgttttccaactttagggtatatcagaatcacagatagctgaaaattttggcctgtccaccaagccatttggcctgtggacaagtcagttggctagctggtgctgagagtgcccatagtaaaaatggaatgatgcccagcaaaagggaccctccagggtttctgattcagtaactctggggtggggccaagaatttgcatttatagcaagtgtccaagtgatgctgatcctgctggtcccaggcccacactttgagaaccactcaggggattttggagaaaataaaaggccatcccaggtagctgattggtatgcttcttatattgttcacctaactctttgtgcagtttctgccctctcactttcagggagagagctttggtaaaaatgtcaggctgcacacttgtaatggggatgagttgacctgcctatttgtttactatgcagaggaagtccatttccctttctttctctgaagaaagcccagtaaataaaaggcaagcaatagaagggaaaagaactagataaaaggaaaaggagagaagcaaagaaaaaaaaaaaacacaagccatacctacaatgtttgaaaagctggaaccagggaggactgtggacttcatcctcaggcctcaaggaataactaagtgatgagttaggggctgagagacataggtatagaatctcttggcatgtcaggagagtcacacacatacatctccctgcaaaagtattcagtttcctcagtccaggttttgaaaagctatttggtattagtggccagtctctgagttgcccacccaatgtgagaagagaatggttttgtagaactattgcattttgataagctcaccaatgttctggctttgaagtaggtgtcatattttcttttctgttccatatttactcagaggcagtttcttatttgatgtggtccttatattttgctttggtatttgttatatttcctgcttataaacttgatatcatgaggtgtttatttttataccaggcaagagattctttaagaatgattaatgttacaaatacacttttggcttgttttttcattgaagttcctgaggaaagcttcagaagaaaactagtttgccatttgtagttaagagattaaaatctctaaccttaggctgtggctgtatggtggccaaaaagtaaatctgaaataaccaggtattctcatttacatttttcagtttttttcatgttgtctcataaatatgctatatttattattaagtccattatgcatgtgctctctctctctctgtctctctctctcacacacacacactcacacacacactatcagaaggaacattgaaaagagtctcatgatgttattgtataaatcctttagaaacccaggatcaagctggatactcccaatttgtactactgtcacagagaaacacccaggaacttattttcagaaaacttatgtgcttgcttgtaggggtgtttgattatgttttttggcctcaaccattttccaggcagctatagtgcatgatcatatagataagtgaaaaggagaaatgaaaaaaaaattcaggcccaagtaaaataacgacttttgaaaacacctgtcctgctcttaggttacaattagaaggcatggttaactttggcttagattcttaagtaaaaagttgagggaaatctcatgttttagacttcatgtgcacattttttccagtttttctttattcacctatgacagagagaaagtgagagagagaatgagagcatgtgtgtattgtactgactcctgagaagctgttggtttaaattttcatttttttcctctctcagacacctatgtaagtgactttgtgacacagctttcctttcattggcaaatgatctgagatgccacattccccaaaagaaattcaccctatatacaaacacgttttccaatttaattgtgttttttttccagttttcaaatttactggaaaagcagttatttaaacactgaaaactctcgtttttcctttttttttttttttttttggtgttggtttcagaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaagtactccttgtcttctctgttttgtttttgttttgttttctttcatgttaaaagaatgtttgggaaaggtagaaaaataaatcaccaaaattctgttggttcaatggcagccttttcttcctctcttacctcttctctcccacacactgtccttacacgtgtacattttagagttactaaacaatactgtgatcagaatcttcacctatcattattattgtggggtttttttgtagctattcttagaagggggaatatatgtttactcaggaatcttaatttttaaagtaggttaatactgccatacccattttagctcttattctacttcctttctgcacaaacaaacatacacacacaggctccacatttggttgttttgtgtgactgtcagcctactagtcatagtctaggaaagcatttaatctctgtgagcatatgtttccttgttagaaagtgtactcagagctctttggaagacaggtttctacgacaattagtgtggactacactgctgttgactcatgactctgcagaattaccaatacagaaagtgaaattgtagtatgtgatcaggagctgatgaaatgaacctgtttcctcattgggaaattcagcgaattggactagatagactgtgttctttttttttgggaggtggggacagggtcttgttctgctgcccaggccagagtgcagtggcaggatctcggctcacttgcaacctccacctccggggctcaagcaattctcctgcctcagcctccctagtagctgggattgcaggcgtgtgccagcacgcctggctaattttttgtatttgtagtagagacggggtttcaccatgttgttcaggctggtctcgaactcctggcctcaaatgattcacctgtcttggcctctcagagtgctgggattacaggtgagagccaccatgcctggccgatagactctgttcttgagcaggatattgctttaggggcctcattgagcagaagcaacagagaaggaagtcttttgtgggtgagaccgtgcaactgtgcctttatctcccagttccaccagagaatctttgctttctttgacttcacacagcagggatctgagcaagatttcaaggggaaaggggttccactgctccttcactgccactcccctcccccaaatgaaatctgaaaacttcttgaagaccccaccacctctacctttccatgagtcaataccagggaagaaacataaatatactggggcaaagtgatctttgcaaggctgatcttagtgctgtcaactttaggccctcaaagggaaagccaaattgtaggccattgctaaaaagcctggatgcacaacaacagcagattctgctgaggccatttggttgttttgaggactggaagaatggacagcataaaaactggacagcactacaaacatgaaaatagacacctgattgcctctcacagtttatctacagttagggtgaccatataattttttatccaaacaggacacttactgtctaaatcgggaggtgcttattaacaaattattcacagacaacaggtgtcactttttttttttttgatagagtctcactctgtcgcccaggcttgagtgcagtggcgagatctccgctcactgcaacctccacttcccaggctcagacgacaacaggtgtcactaattttttttttttttttttggaatctcgctctgtcacccaggcttgagtgcagtggcgagatctctgctcaccgcaacctccacctcccaggctcagacgattctcctgcctcagcctccctagtagctgggattacaggcatgtgccaccacactcagctaatttttgtatttttagtagagatggggtttcaccatgttggccaggctggtcttgaactcctgacctcaggtgatctgactgcctctgcctcccaaagtgctgggattacaggcatgagccaccgtgctggccaggtgtcactaattgttagtaagcaaccaggactgtcgtggactggccaggatacacgggtcactctagttggagagaaaacttatattcaccagagtgaggataaagattctaaagaatggtttattatgaaaaataggtgctcatgggatttttcatattagaattgggtgataataaggattaattgattgattgcattcattatgttgtttgttctctctctcatctccaggccataaactgtcaggaaacaattctttctagtatgtttttgttcactccttctttgatattttcatcgtaaattgcaaatatttattggggcatatgagggtggagttgagggtaagtggggagatgattgttataattaaaggaataatatctgattcttgaacttctgccaaccccagcaaccattattaatcttggacatacttttgtcagagtccctaaaacagtgcacagtgaatcagatcaaagttatttgcattgtggtacacccagcacatttgccctccttcaacaattcctcatgttcatcctccactgaaagggcagaaagacactgctgtgtgatttggacatctgtgcatgcatgtgcatgtgcgtgtacacttgtgccaaagagaaagagagtcaagagccctttgctagtttgaaaagtactttctttatgttaaccctctccccttcctttgagtttcagtgttgattcttggagaaaaagggccagacagcagactcaagcctgccttggtgttagcctcactttgcaaggttggagctattttagagaactgaacctacaaacatggatggggagggtagccaaactgagaagtttagagacaattgattgcaggttagaggattgaaggctagaaaaggcttgcctttgttctgcgtctccctacctcccaggttacggggaagtaagcagttgtgccttccctgtgttgcattcttctggacgtcgttctcagaattaaccatgggaaaccaagaagcttgactttgatatttaagattcagacacccttacttatgcaacaaaggtatgtgacccaatgtgaaatagtcacaatcactttttctttctcctttcttttttaaaagaggcaggatcttgctctttcacccaggctggagcgcagtggcacaatcatagctcactgcagccttgatctcctgggctccagcaatcctcctgcctcagcctcccgagtgagtagctgggaccacaggcatgcgccatcatgcctgggtaatttttgggtttttgttgttgttgttggttggttgtttgttttttgtagagacagagtcgcgctgtgttgctcaggctggtcttgaactcctggcctcaagcgatcctcccacctcagcttcccaaagcactgggattacagacaatcactttctgatgttgcttttggtgtgaatttttcttaatagaaaaaaaaagatcccctgtctaccttagtattgttaaattctttgagaaatttacttttttttttttttttttttttgagacagagttttgctcttgctgcccaggctggagtgcaatggcgcaatctcgactcactgcaacctccatctcctgggttcaagcagttctcctgcctcagcctcccaagtagctgggattacaggcatgcgcccatacccgactaattttgtatttttagtagagatggggtttctccatgttggtcaggttagtcttgaactcccgacctcaggtgattcgcccacctcggcctcccaaagtgctggaattataggcatgagccaccacatctggccttgagaaatttactttctaaatataaccctaacaatttttgtttttagacttgatctctattctatagtcattgtattctcatgttagcctaagagataattgtgtagttgtatgggaagaccgtgaataggagcaatatgcctgaatttacatagagtgaaacataacttgccaattgtttagctgaaaataaagttttgtggctactttaagtattgtggtcacaattgggaatgcctaaaaaagacaatgtttttgctttacaactgagcttctaaatttaaggactgacttgaaatcaaaccctttaattaaattaattatattatctaaatgaataaagcatataggcatcaagtcagtttctaaaggcgctgaaacaagaattctataaatatctaccatctgtggaatgcatctgcatacaagcatgcaaggcatacttgcatacctgagaaaatatttattacattaatttttggagtatgacagccagttaaaaaatttgagatacagtggtattggaaagacaataaaggatctggctatcaaaaacagttcaaaatgaacatgttgaaaaattcatttgattaatttataaataagattctctaccagtttggatacccaagtaatgttttttatatatatgggttcccacctctgctaactcctgcccaagaagcacagtttgcaggtggatctagaacaacccaagaaatgaacatttcttcttttggtgcccagtaatattaattgcttcgggcctgaaaaaaagacctttcaaagtaagggatgtgttccctaattgaagagagccaccccatcagccacctcgtctacaaagaggtctttctttctttccttctttcttttttttttttttttttttttttttttgacatagggtcttgctctgtcacccaggctggagtgcagtggcgtgatcatggctcactgcagcctcaatctctgggactgaagcaatcctcctgcctcagcctcccaaatagctagcactacaggcacgtgccaccacacccagctaattttttattttttgtagagatgggggtctcgttatgttgcccaggctggtctcgaattcctgggctcaagtgatcctctcaccttagcttcccaaagtgctgggattacaggcataagccactgcgcccggcctacaaagaggtctttaaagtgaaatatgaaaagcatcatggtcttgtttgcatacttagagatgttcccactttctcttcgtgagtggatgtccagtttacttttgcagcaaaggggttgcagttaaaagttgagcaatgatttgattatcactgaacctttgcaaggccattagcaccagcaagcttaagttacttcaagagaaagacacttcatagttgaagtacacttgccttgcttttgttttttctgggcccacatctccagtgatttcagctcactccattgagctttacaattcaaacttcccaaaagcccctttaattagtaacaggtggttcaagagtaccctcgtactacacatctttgtattacttattccatcgttatttgtcatggttcatgatacatttcttatttacctgcttgtagcagcagttttgcctggaaggatgaagtctgttgtggtctttcagaaatgcacaagtggttacatgcatcatgaaaattaatagctcctatgccaaagagagttgcattctcatggtttcagttaacactgacataatgggactatgtctacacctacaccccaccccaaactacagaagctataattagaaatcagtgcctcaccattgggatgtctaaatgactgtcctgccttgaaaacaattttcattgctccctctttatttctatttgccttagttttgcatctccccacctcccaggttaaggggatgtaagcagttgtgccttccccgtgttgcattcttctggacatcattctcagaattaactgtgggaaaccaagaagcctacaagagtactaaacaaactattttaccacttcccaaaatcattataaatacaaatttaaaaaatagtcaatacaaaaagcttttaagaagcaaagtgtagacacatattcaactctcaatattctttttcactcacaatattaaaatctagaattgcaaagaggaagatgggactcaagctatggagtggggaaggggtgaggatggtaggagtacaggaggtgtcaaattgaatacattgagtttacatactcacaaaacaaaaatagagcccttttcaagggggttgacttataagtgttaactgagtctaatcatttgaaacaaagacaagacacatttcaagtatttatgaagcttcaattttatctacaacatctccagaaatattcctgactgaatattttgttatgctttttagattttgttattagaggaatcattaggaacttctcatcctcctttctttgtgtatatgcattgaattcaaaactggttaggaaattgttgaagaaactcatcacatcccatggcaagtgtgggttccctatcactcttaccgtaattctgggaatagttctgttatttctattgggtgcttttgttaccaagcaacagataaaatctagaccttttctgcttgcttgctactattggctgtgcaaaaaacaaaaacaaaaaaatagtgcaatgaatgtatgttaggaggtgaaataaactaaaaggaaatgcatttctagcttcagtacagcgtgttgactgtcatcactgtgtaatgtggcttaaggctcgttctgaattactgaaatgaaatccaggctgtgtgaagagttctgttccagcattttttttttcaggctgcttgcagtagtttttaatgtggtgtttggaaaatgcaggttattgggtagaaagtctcaatgtatatgaaaagagtctttgcagaaaaggctttttatagcagatatggcatgcagatgtcatgataaatgtatatatcctgaggaaggcaggaatgagtatttttaaaagagttttaataagttgagaaggaaatgaggcatcttcccccccacatacacactgacttttatcatgaaacatagattggctcctaaaatcttaaattttaaggtacctcctacagttaccttatcattaagaaagacctctgtcagtcttgaaggattttataggcttggaaatttggtatcaatgtattgtcattatgggtcaataactcagattgattttgatatatgagttaatatggaagtactcagtccagatgatattccctttctatcataccaccccacaaaagcaaatgaagcaaacctaattcttatgtaaataatgtagaaatctttttatttttatgcacattacgtaccgttttatagtaggaattgatcatctctgctacattagtatagttctttcaaaacattaaaattggtaaaatatgtaattgttttctggttggttttgttcaagtgaacttttttctcttcacatccagcagtgttttcttgagcctttgaattctttgtgagcagggactgatgagtaatacacatatattcatatcatttttctcacctgcggcaccttgaatagttctaaatacatagcactggctcagtaagtcattattgttttactaaacaatgttatctcatccaagtatctagtgagatattgctccatgtagaacagttgcatcctaaattaccctccaacataaaaattgattcatttggtcaataaacattgaaaactgaaaattgtcactagaaaacatccagctccatagtggagtgtacattgtacatggagatactgtactagttctaggagctctggtgaaaggattaggcttatgtactgccatcaaggttcctatagtctgttactcaaaagaagccatttaggtacatagcatggaagtcaagtacacctactctggaaccaaattgcctagattcaaatcctggtttggccatttactggaagaccttgtgtgagtcccttaatctctttggggctccacttcctcatctgtgaaatgagataatactcatgttatgtgattattttgaggcttaaatgagttaatacatgtagagtactgagaatagaacctggcacatactaaatactgtgtaaatgtatcatagaaaccaataaaatccagtaaaatctatcagtagtaactctgccatagaacagaaaaattttctcttgaatcttgacatcaaaaccctcatgaccacgaaaccataaaagctaaataagcattttctttaagagatcattaaaccattctttttatttaaagggggaagggaggagtgtacagtttttcttttcccatttcttcatatgattttaataaataactattaaatcattaagagaggtctgaaaaatgtgactttcgtaaaaagtagtcataactcctacccctgctcttaccccagccccaaggattctggaacttactaatatctaggctcaaccaacccttctaaataaaagaaaaaaacatatcaaatgttagtcaagagctgtgccccaaggtagcaatcaaattgaacaatttaagtggcacaccatgccatgccatggagaataaatacataactgaagattaaaggaagaccttttcgttaatccctgtgtggcatgatctactgcttggttttgggtcttacggaataaatctacttcagcaaataagttttggaagactcaaaagaagtaattgattttgagggttaccagggagtagaatgttgaatgaacttgaatttctattcaaaatgaataaagccccagaacaaagtctgacttagtccactgttatgtttgcttaagggtgagagatttgcccctaatagtgtggagagaccattgagagctaatgaaagagcccccagcagtgcctggtatattaccatgtgacagtaagtgccaccactggatccagaagatcttggactttcaccagaagctccacgagagaacttaaattaaagttgcagattgaacatgccaaatctgaaaatttaagatccgaaatgctctaaatctgaaactttttgaataccaacctgatgcttaaagaaatgctcactggagcatttcagattttgggtgttcggtttagggatgctcaaaccataattataatgcaaatattccaaaatccaaaaaaaaaaaaaaacccaaacacttcttgtcccaagcacttttgataaaggctactcaacatgtgccatatactgtgtagctttttcttccatggtggtggcatacttttggctcttaaagactccaaaagagaggcaaccattttgtttactcactagggtagtccagagtccttgacactctgggctcactgttctgagcctgggcaggtcgacaagggtggggaccaaaggcctgggcagtgctagcattattgctgtttcttctagggggatgagactttgcaggggagacctgtttctttaggtctcgtgactgttttaaaactcttccctttatattagggcctcatcccactaaaacggatttgcttcccagattctgaattcccttcatgtgaaatagtgcatggtggtctgactagtggttatgagacaaaagacagattttttttcctaactttgatattttatatgtcctttctctttccatttttcttataacttcctcatctctcttttcagttctggtattatttagtgtttccctagcatgttgtagctgagttgcctgtgaccatttttagtagttacacaacaaatcatgtacagagcatgagccagcacttagccaaataatgaaatggaagaactctgccaaactcagcatcataatttcccttaataaaactctactgtgtcatttagtttggtctctttttaaaacttgagcctccatcagcctattttaggggagggtactacaaggtctgttgcataaatgatttgacttgcaattgaactaagaatacaatgaaccacttcctagagttattttttaaaagaatgagaaaggacttctttgaaaaaagaagtgttttctgaatataactattttgggtctaaaatttttgctcatttcctaaagtcctgtaccacattggaattgctttgtattttgtagaacaggttttgtattctaatatagaaattcttaacttgccttgttacctaaattcaaatgcattccagaataatccctggcacatagtaggtgctcagtaactatttgttgaccccttagctttctacgtttcttcttacgagggcattgtctcctcttaagcataatattcaacaaatgccacgtgctattcagtgatttttcatttcatagccacttgcataacttttacctctttaaaatctagccattttgcagtctcatcaatgtggaacccaactaaaactaaagtaggaaataaccagtgcctaagattacagtttcctgtcatctggcagggaaacgtgatacatctgggaaatcttttcatcacaaatgcttgataaggtatagtactggaatccgatgttgtgaggtgactgtcagcaagttgcttaatctctttggctttggcttggtttttcttatctatcaaatgtgagagcaacactcagtgatctctctggtcccttccaactctaagacttctgtgatcctatgcttctcaggccacctcccccctccagtcctgtttgctcctttacaaaaggagagggggacatgtagggaagtcttaacaatctgtgactttaaaggaatgaactttcagctgtccagcaaatctggctatccagaaaaggccattcctccagggtatattggttagccaaaattttactgtacattaatacatagttaggactaatttagtgcctaggaaaacatttgggaatggttaaaactgtggaaaaatcttaattcttggtagggcagtgtatacaattaccattttattgttacacgtattccccccttttaggctagagccttgtttgggatgaggggaatggatgtgcacatgcatcacgtaggagcctgactgttttttttctcctgacaccactaatcccctgttcctgttcctaagggcactgctgataagtgatatccaaagtaacactccagagcaggtgaagtgcattgccgggctgccctgcatcccagcatctcttccctgtggtggtatctgcctccaaaagtctgtgttagcagaactggtgggtacttacacagaagaatgcactaatcctctgatactgactccaaaagaggagggtggggcagagagaaagaggagacaggaacttttaattagctgctagaatgctatacctagccccaatcctttctaagcattgaggaaaacaagtgaccggatggaatcagctcttctacaccccaaataatttcactttataaaactagatgaaatgaagtcccatttctctggagaggacagccagcccaatctgacttgggtaatgtttctgtctttcttcctttccttcctcacaaacttccagtcatagccccatgtgtcctgccatatggtgtccctgtttgtttgtttctcctttcttcctttctttctttttctttcttcctttcctttcctttccttcttcctttcttcctttctttctttcttttgagacagagtctcactctgtcacacaggctggagtgtagtggtgagatctcggctcgctgcaacctccgtctcccaggttcaagcaattcttctgcctcagcctcctgagtagctgggactacaggcacacaccaccatgcccggctaatttttgtatttttagtagaaacggggtttcaccatgctggcaaggctggtctcgaactcctgaccttgtgatccgcccacttcggcctcccaaaatgctgagattacaggcgtgagccaccgtgcctggcaactggtatcccagtttctgcctgatgtttaagcccctctaaattctggccacacgcatactcctgtgcacctgaccttatttcccgcaattccccaaccccattctgagatgcagtgacatgtcctgtactctcctacaggttttgttcatttcattgaacttaactcaggatgctctccctttgtttgaccacttaagtccagcccctttctcgaaaatttaaccaaagccccacctctttcatcaagtgttctgtgaacactctgtgctttagtactcccaagccttggaaaaccttcacacaccccctaagtttaagattactcatattctgccttgtagaatatattaactttgccttctgcacagctcttggcacagaacagaagacaccgtaggtacccttctaaaccttaatttggggttagggttcaaaggacagccttgtagtcaatgtaatgcagaagaagatgtgcttctgttccagtctggcaaagacaaacactgatggttgaggctattagcaggacgtgcatggtgggcacatgaagatagtctcctccactgcatctcatggctcaccctgcatagttatttgtaaaaggattttgagataattgagcaatttatgtgtgtgtgagagagagactccaggagggaagggggtgggggaggaatgggtgtttacagggtgggagttggtgcaccttgtttgttttgggtcatctccctcctctcccctgtcccaacatgtatcttttatctaatctatgtcttcaggaggcagtccaggcttactaattgtgatcaatcacaactcattcttaagttcatggccaagccttcagtgtcaatgtgatagaagcaatttctgtctctattttagccccgccactactgtctttttttcttttcacacattaggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcataggtgagcaagtggttaacatatttgtgttgctggagatagcttagcttccagtcacaaggaatgttgtaattggcagctatgaaatttgtttgtttaagtgtttgctatttagtgtttgtcagaatcctgactacgctcaactactttgagaatagtaaaaacattactgcaagtgaatgttccctcaaactaatggtggcatttctgaaggtaatagatacagtggctgccaggttttaataatgagaaaatgcctttttcttggagacagagtctctttctgtcacctaggctggagtatagcagcacaatcatagctctgtgtaacctgaaactcctgggttcaagcgatcctctcaccctcagccccccaaaagccctgggattataggcatgagccactcactgagaaagtgtctttttgatatttcccgcctgaaagtcagttgtgtttatgattataggcttgtatccatgtaaatgctggagtacagtcctcatggagttgtaaaagtggcttttaaaatgttatatctattacactgcaactaaatcttctgcaaaccggccagatacgcatttgttatttggatcaggtgaaatctgattgagaaattcagggattctgtttctgtacaccatttagcagtagtagtctgctctggtgagagtggaaggactttagccctgagaatttaagggatacatattcctgcatatatattccacctagaaaaccattctcagaacccagacagcaatgtaaatgaagtggccaattgcagagagggttagttatgattttggggaaaggacaaattaaggagaatttaaatgtccagttgtcaattaccttgatgcctgaagcaacagtaaccagtgttgaagttccttatgctgagtattagtaggaccgcacacacatactaacagctcacaaaaagaaactcacatttttccccaccctagtcacctttgcataattgccgaatttgagtgtctttataagcacctgtttttcacttatttgtccaaatcatgggaacatgtatgcagtattctggcttggttttttggggggaggtgaggggtgttaatgttggggaatgctttttagtctgtgtgagagctaattaccatattaactccgtttgaaagtgcatcaataaattggctccaacagattcttaagaacactgacacagggggataaaaaaagatgtgaatattaagcacttcagcacaattgtagcctaaatagctcaaagctagaagacctgaaaaaatcttctacacacagaaaagcagaatctcatgaaagggaaggcataagaccagcaaagacatacaggccaaatggcacatcatgcccagaatgaagccatgggagaaattgttgattcaaaatatttctcatggaagtaaaaacccatagaatttccagatctaaagtcgctgtttttgttttctctctctctctttaatcccacactcatccccacacccaaatgtcaagtttgcagttcacttttgcaaaattgaatttttaaagaaagttggtgatccttttcaattgcccctataattcactgtttctccaggcaaggtagtagaatttgccatatggtacaaaaaagtgtatggtgacagtgatcgaattctgctgacttttctacagacacattgggaatggaatgcagaagggcatggcccttgccactattttgatactctaacatgtctagcagcaactataactaaactcatatccttatattaaaatacaaatgctcctacgtgtttttcctggagtttacaggtccatatcaaatcaaaaccacactctggctttctttattgatgttttaaatcagttactcgaaaacaaagaggacttaagttgctgttgttgttcttgttgggcatttttaaaattacatttgttatctttgaagaaacaaacccaagtagaagttgataggatttctgaatcgatttttccctagttattttaagtgataactttttggagggatgaggtatataattgtatctaaactttgtttttaatgggtatactattctttatttctaataagcagatataaaagaccaggagtaatagacattgttaatctccagtgctttttcatgaatttttcacaagggtttaattaatctgctttgtggttgtagaattcagtcccaatttacatgcctctgctgtaaattctttttttatttcttgtctctctctctttttttttttttctgtttgcaaggaatttttctttcccctttaaatgactgcagctaatgaatggtcaagggctttttcccccttctttaaatcagatcttggggttaagtcgggaaactgccttttgttcttccagtcaggtcgggaggctgaagatgtgggtttctgattattggcagcacaatgcaaaaggaatcgctttccctagtgagaaggggatgctttgttgctgggggtatggggggaaactcagtgccagtgtcttgagcactgaaataatgcagttggactagaccctttaagagactaaggatgaactggttttccaaatccgtcttcttgttgccatgctcttcctctcctctcttaactgcatctgcaactggccatgaattgagaccctttagtaaatgttgaagtcttgtcagccttttatcaggatggatccaaatagttaaaacaccttagaacttggttttataagacgctggtttatatgaaaccttcacttggaaatataaaccaaatacctcccttgcccccaccaacaaaagtcagtttctggagaatcataaattatgctatgcaacttgttctccatcacatactgtagctgtgttaacactcatttgactcagggccaaccctattaatgtcgcatgttgctgccagtgggaatttagtattgggattgctggcggggacaccagccaggtcctggcaggaggcaggagccagtcagatatcccgcaaacaagggcctccgtggctcgtatcagccagaagaaaacccaaactccaaaccaatcatctttggctttctcttgaggcttcttatcagggctggctgctgttacagaagagccaattgatagccaatcatgacttcctccaggggttagaggcagctttggctcccgggctgcagagtgcaggcagaatgctcttcagttgcattcttcagctgcgcaacacacaacaccatggcaccggccccaacaaaggcccagcttccccctccattcccaggctcttgtgtatagccggctggctcagagtttacaaagacgccaaacagccagaagaattggggtttatgtttcctttcagtctttcacaaacacattagtgatctggccattccttgccactaggggaataaggagttacaaaatgcactgggttttgttgttgttgttgttgttgttatttaaacgtctgcattttagatgtttattttctgtctattcataatatttttattgggagcaggtgatttcttctcagcttacgaaggaatgtgctttctgtacgtggcagccctgatgatttgacaatgatgaacacatttaagttgtgctccacttgtttacaaaagtctccttttgctagcacatcaaaagcattttttttctctcctgtagtacaatggtatattcatgctttcagcccttacttagagttagaagcatcacttgattggcgcttaccacaatgcattctgaaacttcatttgttattactgttttaaaaattgcatttcatggaaatctatttgtggtttgtgacatcggaattgtagtttagagaaatgaccccgtgcattaaaatgttgtgtagcatttgttctaggttgaaggtgaaagcttgatgactagatttggtttcattgatatgctgatgcctatgctgctttccactagaaagcttagatagaagctcagctgggggctgcaattgtcagctgtgttctttgggtaggacacaatcttccgggaactagctcttctttcaagtaaccatccttgcactacctgaagatgatagataatgtgggtctaactcctttcttgccatgcactaagcactagagtgtaaaggggggataaacaagtttaaaagttcactgtttgtcgttaatgaagcatcctttttgtcatttggggttttcatttccaagttcttctaattttgtaaaacaggtagcaggcaaaaatactaagcctcataatcctaagaaacatatatggcaagaaaacaaagacaatgtattttattgaagcgattcagtgcttactggaaaatgccatgctactccagagtctaaagcaggataatcggtgaagatatatactgtgagcccactaattttgtgtactgtatcttgtgtcatcttctcacttgcaaaaaaaaggaggtacatgccttaagataaattgaagccattgtatttgcaatgagaagtttttcttaatacaaaaattggattattcaaagttttagtatttgaaaagtcattagaattcctaggaaccctttcatttgtattatccaacggtgcactcaaggatctgaggggttttgtttttaaaaacaaaagaaaagaattaatatgccagcatcttaactgatttatgtttttgactcttgtaaatggaatgtgaaacgagaagatcctagggaagtctctgggagagctggcatgttattttgtctccagccttaggtttgtcatctgggagctaactaagagccttacagtgacagtggctgacacacgaataatcagtattgaggaaagttcctgattgggtttccttgctgtagaactaagccttcatctggccatttcacactttagagagctagtgatacatagtgactaaatgcagtttggtgtaagggaaatagacataaaaacaagaattcattatgatccatgccttacttcccctgcccccatgcaggaaacagacagaaaaaaaaatcagattgatttacccaaggccaaactaatgattgactttttatgctgtattgttcttccccaaacctcatattagatgctatgctgatggtggcagagaggctagagggtcctttcaacattgaatcggtcatggatcccatcgatgtgaagatttctgatgctattatgaacatgcaggataatagtgttcaagtgtctcagaaggtaatgaaggcaggatgctggaaaggggagctagggacctcccccgcctccgcctcccgccttgggagtgacttccctaacatgacgacacttactctaatgcaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggtgagcgttttggcaggaagggccgtgtttaatgacaaagaactgaaaactcttgctcaaaatgaatttttagctggaaggctaacaagtgtgggtctttcaggtgtcacttttcaagcaaataggatgtggatgtcagtcaatctgcctgtcccattttctagcccagaaagttcttgggtagccaaggagttatgatgcaataagtcttgtctcaaaatttctctttagattcaccatgcatttattgaacatctactatgtgcccatcactgtgctaggcatagagaagctcagagaaataaggcagatccttgttctcaaaaggcaccaacaaggaggcaaagagggagaagtagatgttccaggcttattaacataaaatgatgtttagtaaaagctgagatgggagaaaagtgagtaactgtaggcaaattgctttatccacagtaatatgctacaaaaatgtaagaaactattcctacagtagtaggaacacagaagagggagcctgaggagacagggatggagagaaagagcaatagcagctatgtttcacagagtgcataatatacatgcttgatcctgactctaaaagccttaggagaagagactgcatgttatctttgtgcctacagggcatggagactggtaggcctcagatggtacttacaatgaggtgggcaaggggtctaggccactcctttggagcttgcatttcaactattatttgagtggttttgtacttctaagatataaattggagttgcatcttcctcttctaattaaagttgaaaatgaattgcatatcactctggagatactttggaaatggccagaaggcacacttgtaggtagttttgtcttgtcttacaatgatctttttttgttgttgttgtttcataattaggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggttagtgtctgttgaatgaatttgaagtttctcccttcctagatgcctgggtgaccttcagagagggttctctcaattgtcaaccgaggcatcaggaagcaattcacagtaggtagcaacaacatggaaggcttctaggtgttcttaggaacaggctttgcactaggagtgttgagaaggcacccagttacttacaaagagtgctgagtcaaaagtttgacagtagttatagtctcgtattagggctgttccaatagtgtcattatttttaaaatatttaatgcctgtggctctttgtccaatggcctagcctcataaataaccagttctcaaaggttccattctctgacttgatgccctgtgtccctcccttagacgctcagtaacttagagaagtacccatacttttttttgtttgcttgtttgagatggagtctcgctcttttgcccaagctggagtgtagtggcacaatctcggctcactgcaacctccacctcccgggttcaagtgattctcctgcctcagtctcctgagtagctaggactacaggtgcctgccaccatgcctggctaatttttttttttttgtatttttagtagtgacagggtttcaccatgttagccaggatggtcttgatctcctgaccttgtgatccgcctgcctcagcctcccaaagtgctgggattacaggtgtgagccaccgcacccagccagtacccatacttctttacttcaacccaccatcctcctcaagagggatagctagcttccttccttccttccttccttccttccttccttccttccttccttccttcctccaacagagtatcactgtcaccctgctagaattcagtggcacaatcttggctcattgcaacctcactgcaatctcagctgctggaatgcagtggtgcaaccttggctcactgcaaccttcgcctcctgggttcaagtgattctcctgtgtcagcttcctgagtatctgggattacaggcacacaccaccacacccggctcattttcatatttttagtagagacagggtttcgctatgttggccaggttggtctcgaatgcctgacctcaagtgatccacccaccttagcctccaaaagtgctgtgatagctttgaagaaggtttccatcaaattggagaaatgaggaatccacaggaacaagaaagattagagttcattaggaattaaagaacttccatctaattttgcttagtggaaatactagaatctagcagaagtatttgataacctcttgtataatcttcataatcttcacgcctgtaatcccagcactttgggaggcagacagataaaatcttttcgctttacgaatcatcttactggggtcattttacattccaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtaagcatttgtggtttgaaagtacgaattgctcttgtatgtcttctgatgagaacaagtggaatgaaatttctattccatttttttttaaactaggtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctggctggtgtgtataagtggttttttttttaaaacaaatcagaagacataaaattgaaaaggcactccatttatatataagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagaccttgttagattgtttttaatttaaaaccttgaactctgcccagctgttttcttccagtcaaattctctaaaccaataacattttccaaattaagtattcttgaaggttcttctgaactcttactgatttgttttctttctttgcattttttcctgttactcttttattatttaaattgtctcttgcttttgaacttcaactatgaaataaacaaatcatagatttttccattcaggtctgactggataactcttggcttctaagcagctggcaagctcacccccactccccaaaaaagaagaaaggcaagttgaatattttaaaaccttaagagtttggagtatgaagtagaataaaagccttgttaggagaagacctgacttttccaaagttaacagcatgtgaagggcttgtgttttacaaagtcatttataaattatttttctttaaaacacatcacctactctgtaccttaaagattttacaactcttagatttatattttatttcaaaaatcgtaactagcacctgttattttgattaaaagacactgcgaagaattgacgtaaatttctaaagtttagttactgagtgttcaaaacctaacagttcacatgaagtaaaaattgtcatttgtgattacagaatcaaaataaaaataggtatgaatggtgct

SEQ ID NO: 5882 - DNA, 114141 bp, human
gcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtaggtgggcacacccgggaggtgggcgcagagaccgacacttcgggaagggaggctgcaactcccttcccccgccccgccgccccctgcgccggacgcaggtacactagagggagaaatgggcagtcgagagggcaggagcgagcgagcgagagagccaggcagcccgggcgcaggacgttccccgcgggcgcagcgctccccccttcccagcactgcgagcggaggggcgccgccgggttgcccagtgcgactgtcgcgctccgctccccgcctccgctcctcctctcccccctgcattattcgccgtcccgggaagcccctgaggactgtggccctcaaagtgcgtgtcaccggctacttctccttttccgggttgaactccttataggacgccccgctttgttgtatgggtgaggagaggccgggtgggggtgggggtcgccagtggggtgtggtggagggaaacgtcccggagcttgctagattctgggggtcgcaaaacgtggaacttgaattgatgtttcattgatgttcttttaaaactctctccccgcctctcttgcaccgctgacaaggattaggagttttagtagccgcaaccgcttcagaagtcgcctttaaaaagcaaacgactacccccactctccacccctccaaaccctgacttttgggaactctcctactttccggaaggtatcagaccagaggagtatttttcccctctttcttttttcttacctcattttaagggttaattgcactttcaattacagacctttgaaaggactgattacaggaaacctgaatctcagtttggagatggttatgcaaatagagacggcttagcctgtgagaaagttcaccggattttggcgccggtggggtgggatggggggtgtatgggggtatttgtgaaagcccctctcggagcgctggggaggcagcgttcggcgggtgccctgcgtccctcccagcgaagctggcggcggtgtccggccgggtcccctccgggtcgcactgtcttcttagcagcggccaactgttgcgcgcagccccgccggccgcgcaggtagcccgttcgccctgggggctcagaaagcaccacgaatctagctggctggtggccagcgtaatctaacggaggagtgagagattcgagcccggggggggggctgagcctccactccgaacctttcatggaagtgagtggagcgcgcctttgccttgccgtgctggtctccgggtggggcgggcagggggccggcagccagcaaaggaaatactgtaatttcaaccaggcgcttccaaaggcttaggaagatttgggggtcattttttggaagggctattaataaccttggagattaagtgcagtcatcaattacatattaattacaaaggtaattgagggaagttgctgggcacttttggagtgtaactggcgtctgtctagaaatagaagcgaagaaattgttggagcagcccaggcgcccactgcaccttggcagttaccaaataacatgctcactactgattagacactgtttgcccttcagctgcctgtcttttggggagctcaagtatgtcctcaaagcggcacgattttattggttgtagagccctgaaaagccctctttctttcccttcctcctgccccgccagaaaaaaaatgaagtgaaccaccagccgctgaagcttggggactctgcaggtcaaacctggggtctttgtgccctgcacagtttaggcctgggcacagcggagatgattggcgtgaaggttacagttgtcattcccacattttgaaggggtagatgcagctctgcacttaatgggaatgtgacaaggtttcatcttctgctcatgcaaacaatatgtgcctttgatattgactgcaggcattcagcgagtggggttgtgaaactgccctccccagtttccccaactttgctctgtgcagtctttcgctgtggcagggcatcttccccagccagcatctcaggaaaaaggaagcttgaagggtgctcagagactctgtgctaggtgttccctttgattgtcatcatccccagaaatcacctgagggatattttgcgtatatgtctatctggacattcccccatgccaaagataggggagttattagtgaccagcagcaggaaatggaagctaatgtgctcacacccaaaacattttattctttttgtcttgtccttcatctccctccctgggctgctgcttttatttccccttttgaatgacctactggactgcattctcctgaggaacaaaggaagtgcctttttagctggaatccttggaagaccaccaaggactttagctcatgcagtgcaatttcgcaccactttcaacaataacaaaaatgcatgactgaatggctcaaaaatgtggagtgttagaggcattcatttgagtctaggacactgtcacaacacagacagacccaagtaaatacctttagacggccagtatagaaacaggcgtaatctttaccatcaccctggcctctccagatgcatacattagccttgtcttctctgagctacactcagataattttggtcattttttaagggggatagtcaatatagtgacttgtattcagcctaggtctggatggattaattgccaggcactttgcctgggatggggaatgtgcttttttcagtgcaaaacacccaggatcattttccaggtgaagtatcacaaagtctgggtacctagctcattgagccccaggctcagcccaagtttaatgttttattccagatggccttgcacttgccttctagaggtttgaacaggctttaagaatactccatgttctggaggagtctcagtctttatagatcatagttaggatcatctgatgtgctctcaagggtgtcagggagtacatcatgctgacagggcttccaactgaggtcctgcattgcctgtctgcttgacccctgtacttttcaaataatgctgagtccaggtgccatgatcaaaagggatctttaacacaaagattatgtttttgttcagctttcaatggccatgtacttttggagcgcccactatgtgcagtatcctctgctcagcattgtggagacagcaagaaaggcaggaggggcttctgccaccaggacctttcctattagtaaggagataagccacgcacacacaaaattagaatacaacacagtggtgataagtgccatacaagcgatacagatgacgagaagggagtgcccaggcatttcaaagagagaagggatttaggactctaatactatagaatattaactgggtaaagctagttcactagtaaaaatgaaaatactaatgaagataagtttaaaaatctaaccattttcattatgcctccctccataaagacaaaggtaaagggtatgcaacaatgggcattttattactcatctatgttgaaattgtttttaagagtgaggcagtgggttagaagcattcatgaacttgccaaaggtcctcttcacaatgacattgaatgatactcagaactttgtgccctagttgcagttttggagtttttatttcttgttcccttctgtgttcatgagcaatgcacctatgatcatgtgctcacacacacatacatatgtacatgcacaaaggattccaggactcctataagctgttatgactacgtggaaaaaaagtacgtgtgtatgtgtgttggagaggtagcaatactttctaatagtgagttgattatatatgacacacagcatgtgtctttaagatttgtattccgccttccccaccgtaagtaatgtgttggattttgcaatgaatctgtgatctcctgttttgttggaatcatcaatttggctctgtgtttcacttggggagggtcgaattgagccacagggcctatcactgtagaaattgtcccaagtagtttacaggaggtatcttctggacatgttcaaaaaagaatttagttaaagttctggcttatgcagctcagtctctggttagaacatataaatataaaatgtctgattcagcataattactgttttccttttttatttgattcacgttgggttgcatgcaatttcaggattaactggagactagactgaggaatgaaaaaggaagttttttgttatgtgtacaagggaaacaacattggcgttaatctgaggcagttggaagtgagtctctctggctccccaatgacattaactgttttagcactgaggtttttttcttatttatgtttttaaaaatgtattttggcctcatgataagagttcgtagctattgaatgctttctctgggcctggccctataccaaggaacttacatgattgtctcatttaaaacccacaacaaccatatgacatcagaattatcatctccattttatagacaagaaaacaaattcaaagggattatgaaatatgttcacaatcttatagctaatgaataacagaggtgggatttgaacccaggtcttatctgttctagagtatagttcatgctatgttgtacagatagtaagacaagaaagtaccttctctattcccatagaggttgttgagatataaagtatgggaggaccctcagctaactagtaacagaccatcatcaaaacggcacaattttcgtgttatagtggagaggatccagtcacatcttttgtagacaaaatgtcaaacccagacatagacaatctagtgttaatggtagaaggaatataaattgtatttcctggacaatacaattgagccaatgagggtttctgagggaggggaatgtcgtcagtcaagctgttttaggaagataactagtggctctttgggttaagggttggcgaggcaagagataaagacagggaggtctgtcagcagactctttttaaatagttcttaactggtctacctgcctcttgtctgtccccccctcctaaatccctgttctatcctgaacatcgccagcttaatttccttacatcactgctttgattagagttattcctgtgctttgagcttcagtggctccaagcatctcaaatgatacttctttcattgagtcacttctgaactctccagggttatgtgcccacttcttcctaattccctgttggaaccagtccatggtctttgtacataactgccttgtattatagttaactgtgtgtgcaggtacgtgtttgtcttctcaactggaagcaacttgagggcaaagatgacaactcctcgtcttgtctgtgggtagcagtaccaagtgtggtaggtcagtgcaatatttgttaaacaagtgggagaataacatagccaattctattgtgttctctgtcagacactagtgctacaatgagattatactgccttgatgatagattgtcattccatggtctgttgatctcctaggaatcttttggatctaaacactttttttttttttttttttttttttttttttttttaaggcagggtctcactgttgcccagactggagtgcagtggcgtgatcttgcctcatcgcaacctctgcctcccaggctcaagcaattctcctgcctcagcctccagagtagctgggattataggcatgagccactaccgcctggctaattttttttttttttttccaagatgaagtttcgctctgttgcccaggctggattgcagtcgcgtgatctcggctcactgcaatctccacctcctgggttcaaaggattctcttgcctcagcctcccgagtagctgggattataggcgtgtgccaccatacccggctaatttttgtatttttagtagagacgtggtttcaccatgttggccaggctggtctagaactcctgacctcaaatgatccagcctcccaaagtgctggaattacaggcatgaaccaccattccaggcctgtatctaaacactttgaagtgaaataaatttaaagtaaatatgcatatgttggtatagcttggagaacgtttttattcttttgggggagtacttgtctttaccacttcattaataactgaatgcttataggatttttttttattttttgaaacagagtttcgctcttgttgcccaggctggagtgcaatggcacgatctcagctctccgcaacctccgcctctggttcaagccattctcctgcctcagcctccagagtagctgggattacaggcatgcaccaccatgcccggctaattttgtatttttagtagagatggagtttttccatgttagtcaggctggtcttgaactcctgacctcaggtgatccacctcggcctcccaaagtgctgggattacaggcatgagctactgcactggccaggaatttttcagaaagattcagaattgtttttcttaatgccttgagatacacttctttaaagaatgaacagttgagactgttgtgattaggcaatttagagcaaatttaccacatgcaactgttcagtgtgcatcagttaccttttaacataaaaaaactcaagtttattgtctttaccaagaagaacacaagctttgaagggtatcagaatattttatataaataaacagacatactaaaatacaaacaggtaaaaactagcattttcaaatctacttggttaaacatctgttgcttactatagagaacatgaaagtgcagaaaatgcatgaagcgattccatcctggaggtaatttgaaatattatgtttaagttctgatgcatttaattcagcaatctggtgggagagaaaaatcaaagagctgcatcagccaggtattcaacttttgagaaagaaactctaacaaatgttagaaattaggggaaaaaactgaatgggagagttaaaaaagtcaataacctccaggaagcctggaaactatgtaaaaacatcttattggaagcccagataaatgtgtgccagacatcaaaaagaccaactgctcgggggaagaaaaaaagaacccggcatgactaactggcagagtaaaagaggctgcttcagggaaaaaggcatctttcacaaaatacaaagagtttaagccagaagagggaagtccactaggtttcacaaggcccaggtacaaactagaaattaagtgggctgacagagaattgaagttgaatcttgcaagggatttgaaagatggcatgtgtgataataatggtgaaaagggtgggttgagtccaacctatctagggagaagcaatatggcttctttaagggtaaaccatgcctgattgatctctcgggattctttgtgtggaaaaaaaagcatgaggatacagggaagcagacatacatcatttaggtttttaaaaattatgcaatgggattctaaggcaaagaatattcagaaaatatatttactttgagataggtggggatagttggacagagagggagagtgagggagggaagagactccactgttgtagatggagtagtttacatggagaagacatggcttgttaggatgagtagttctagcctaactctggcaaatttgttgtcaaatacctttggtgaggttcttccctctttgaaaaatggggtgaaattgaaccacctggcacctgaggagcttttaaaatatactaatgcctgggtaccaccccataccaatgaaataatacttttttcaggaaggactaggccatgatggatggatggatggatggatgaatgtgtgtgtgtgtgtgtgtattttttttttttgagatggagtcttgctcttgtcacccaggctggcgtgcaatggcgtgatctcaacttactacagcctccacttcctgggttcaagcgatccttctgcctcagcttcccgagtagctgggactacaggtgtgtgctgccacacccggctggttttttgtatgtttagtagagatggggattcaccatgttggccaggctggtcttgaactcctggcctcaagtgatccacccaccttggcctcccaaagtattggtattacaggcgtgagccactgtgcctggcccatggtagttttttttaattttcttttttttttttttttttttttgagacgaagtcttgctctgttgccaaggctgggtgcaatggcatgatctccactcactgcaacctccgcctcctgggttcaagtgattctcctgcttcagcctcctgagtagctggaattacaggagcacaccaccactcctggctaattttttatatttttagtagagacagggtttcaccatgttggccaggctggtctcgaactcctgacctcgtgatccgcccgcctcggcctcccaaagtgctgggattacaggcgtgagccagcatgcctggcctaggtcccttccatctctgagattctattattctaaattttccaatgagattcatcacaaaatgttgtttgagataaagcctttagtttagaatcagtgcatggttgttttaattttggctaacttggatttaagagaaaggtgtgtcaaacatggaggaaaatgttttcaatcaagatataagtgtgaaccacaactgagtgctgctttgctgcaggtagagacataagacaagcacaatgagaatactttggaaagaattagaacagaatccagccttgctgtcatttattgattaagtgtcaacatgctaggtgatatttcttccctttttctttattggtaaaattaaaataaatctctttatcccttactttaatgtcctctttgccatgtgtttattctcttcaagtatcttatcaagaaatagaagtacagtaaatccctaggcttctagctggtgcaaccatccagaacacagctgggaatgtggaagtaagcagaaaagccaaatgatggaaacagctgtcataaagcccatgcattctatgtggagaaaaggccttcagaaatttattatcagcaatcattgaatggctcctgtatccagagcagtatgctgggtgcaggggattccaagaggtgtcaagcaggaatcaagcttttgaggaacttgcattcaaattaggtagatagggtttatacgtgagaagataaaatgctttggttatccagtttcccagtctatggcagattagaagtagcaaatggtattggttgggggccgatgggaatcacaggaagggatcgtgttagaggcaggtaagacttgacatctggaagaagtgagagaggacagttggagggtgaccagaagctgaatgggagagccagaacttgctgatcttggcagtttgagatctcctagaatgggcgaatgctcaaagccacctttgtaaccataatcatcgagggcactagtatatttcattacagtattaaataatggtgtttggcttattctgatttaaaagttcagaaagtacattttagaaagagttccattactgggcacggtggctcacgcctgtaatcccagcactttgggaggccaaggtgggcggatcacctgaggttgggagaccagcctgaccaacatggagaaaccccgtctctactaaaaatgccaaaattagccaggcgtggtggcacatgcttgtaatcccagctactcgggaggctgaggcaggagaattagttgaacccgggaggtggaggttgcagtgagccgagattgagccattgcactctagcttgggcaacaagagtgaaactctgtctcaaaaaaaaaaaaaaaaaaaaagagttctattggaaatattcaaaatatgaaaactacccttaagggggaaatttagttaacttacacatttacctatctagagcacccagtttcccaacagtgctggatcaacaaggagtcaatctacgtgtcactttgtctttttattttaaaaaatgtgttaaaaattgtatattattaattcagtggctttttcacctcagagcttgtggtttatgattttgttcctctgcacctttttttttttttttttgagacagggtctcactcttttgtccaggctggaatgcagtggcatgatctctgctcactgcaacctctgccacccaggttcaagagattatccctcagccttccaagtagctgtgattataggcatgcaccaccacgtccagctaatttgtatatttttagtagagatgggctttcaccatgttggccaggctggtctcgaactcctggccttaagtgattctgccttggcctcccaaagtgctgggacaggcgtgagccaccacgcccggcccctctgcaccttctttttttttttttttttttgaggcagagtcttgctctattgcccaggctggagtgcaatggcgcattctccactcactgcaacctccgcctcccgggttcaagcgattcttctgccttagcttcctgagcagctgagattacaggtgtgccccaccacgcctagctaatttttgtattttttagtagagacggggtttctccatgttggtcatgctggtcttgaactcctgacctcatgatccgcccaccttggcctcccaaagtgctggggttacaggcgtgagccaccacacctggcccctctgcaccttcttttgaaagccctctagaacatctaggttcaacttagtttctgatactgtactacctgctgtggtcagtttagggaactgagttttgacctgaagtcaacaacagttggttcctcgttaagggtgacacatttgaatactggtttcccttgtaaacatttaccaaactaggtaaatgtataatcataagaaacactagaagttaaggatagtgtctgactatgtagctatttgaaccttaaaaaaaagcaaagcttggctgggcatggtggctctcgcctgtaatcccatcactttgggaggtcgaggcaggcagatcacttgaggccaggagttcaagaccagcctggccaacatggtgaaaccccttctcgactaaaaacacaaaaattagctggggtgtggtggtatgcacctgtaatcccagctactcgggaggctgaggcacaaggattgtttgaacttgggaggcagagattgcagcaagccaagatcacaccactacaccccagcttgggcgacagagtgagactctgtcaaaaaaaaaaaaaggcagctctatgtgccctatcatgccagatctgagaaaccatgtatccccagttcctaacatactgcatggcatgtggtaggtgctcaggaacgttaagcatgactttttgtttctgtactcattccaggacgagatatttttattcatatctgctgtgctcttactctattcttctaaaattcatatgttgaaatcctaaccctcaaggtgatggtattaggaggtggagtctctgggaggtaaaccctcatgaatgtgattagtgcccttataaaagaggccccagagaaaaccgttaacacttgcgccacatgaaattacggtgagaagatggccctctatgaggaagcatgcccttaccagaacccaatctaccagcatcttgatcttggacttcctggcctccagaactgcaagcaataaatttctgttgtttagaagccacccaatctttggtattttgttttagcagcccaaacaggctaagataaccctttttaaatctaattattttaagctatctcatttatttttaacttttgcatacattcagtcctagatgcctaagtaaggaaaggaaaaggaaaacatgtttttttaccccttaacctagagcgtggtgctctttcttggcttgcttggaggtgggcgcttagtatttcatgtggtttgttttaatcccggtagacaaatggttgctacttcttacgctgtctgttccagacattagcaggaacttggctgtgcctgcagaggtgctttttctttctttcttttttttttttttttttccttttgagacgtagtttcactcttgttgcccaggctggagtgcaatggcataatctcagctcactgcaacctctgcctcctgggttcaagtgattctcctgccccagcctcctgtgcagctgggactacaggcacccgccaccatgctcggctaattttggtatttttagtagagacgggtttcaccgtgttagccaggctggtctcgaacccctgacctcaggtgatctgcctgcctcggcctcccaaagtgctgggattacaggcatgagcccccacacctggcctcagaggtgcttttagaagaggctacctttgcccctttttgttgcatcagcctttctactaggtgctcacttccgtcttcttctcctggaggtttgggtcaggacttgatctctgcatcatcgcaaccattcttttcatgctagtcctttctttgcaaagccactttgttagtttggcttttgcaggcctcttaaagcctgtcttctttcttctgttcaccttctgcctaccagagcaggctggaagtggtttcttttggactgtagacatttccttagttcaccaaacccttgacgtcatcatcccagcaagcattaagccaccagaatatttttttttccttcagttattgtttctatttcaccacacatttgtctccattgagttttcggtctggtgtttggtcagagatgaaaacaaagcactgtgtccttgcaaactgcagtgtaaagcatgtggttagcagttactacttgcagtggtccagtctgagtgggagtatcatttttcttggcagtgacttcacagaaagtcctgttttttggtgccagagtaagcagtcattacattccttacaatttatagtcaaattattatctactattgtttaaattgccttaattatagaagatttccctgtgctaagattttaaaaagcaaaataagacaactttttaccaatgtactttagaaatggtccttaaacatcacctgtcaccaggatgttggaggctatggtaaggattagttctttgtgtttatggggagattttttttaaaggggagtagtgaaatgagttcactttaaactgaatttgaattaaatgcccccagctggctggttggttaatgttctgccttgttgtttacccacagtttggaactaacttttctttctgccctctcagatctgatgggcctggacacattctgggaggctcttctggtatgaggtcaatggattattaagcagtgaggcagtcttagaagatgttcgtgtattctttaggttggagagcaaatgatgaaataacaaccttccacaataagggactgcatcaattttcttgtaatctgaataaagatttaggtgactggatgggatatgtttcagcttagctaatgtttcataatctctacctttgggctctgctttcaagatatatgtaaaatttgtcatcttaccatctcagtgactactatcctggtctcacccctcattacctcttgcctggattattgcagtcgcccatatcagttcccctgctctagctctctggctctggctctccccagcctgtgttctcagcatagcaaccagtgtgatggtattctcttaaacttagatcgtatcactcctttgctcagaatgctccaatggttccccatgccagctagagtgaaaatcaaggcttatgagcacatctgccttctcctgtgccagcccacgaggtcttctcttctcaggctttatctttatccaggtcccatcccactctagccatgttggtctctctgttttccttcaagcacaccaggcacgttcaggggcctttgcacttcttattttcagtgccttgaacaccctgctgccagatagcagcatggttcactccctcacatgtttcagggctttgattacctatcaccttaatagagaagcttttcctggtctctgtataaaataggatactcccacccccccaccccctgcagacacacacatatattcatatacttcgtccttcttcctctctgctttcttcttcttagttatcaccacctgacctgtgggcaggggctttgcctcttttattcactgccctatacccaatgcctaccacattggctaatactcaaaaatgtttgttgaatgaatacatgaatgagtactccttgcaaataggttgctcttaggaaaaaagctttcagagggcatagttgactctttaggacttgtgaatatgagattatacatatgaactcccatctgtagaaagggggtgcctaaactggattcattcattcagcagatatttagcaagtgcctattaattgctaggcgctggggatagaacagtgaataaaaaggatacaagccaggtctcacacttatggagctcacagtctaaatggtgaggcagacattgattcaataattctgaaaattggtaattagttacagttgtgataactacttccaaggaaaagcccttggtcttggatgtggggtaagggaatggcaatcagggcaaagcatagttttcttgaacattatgggcctataaggccttctcattttctaggagtagtgctttttacatcatcacaagctcccgcccccagtgaatggccagggtttgtgtttctggcagtggatcctgagatgagtcctagagcacttgtgcagtagtgcagggaagataggcccgagttatcttggcttacatggaacactttctctggttgcatattgtgaacaaaagttctctgaaaaggaatttggaggaaaaagacttcattccagtgaacagtttgtaaactggggagacacatccttcagtgtaaaacaaaagtgcacattccagagaccaaagagaggattctggtttctggttgtttttgttttgggacagagtcttgctctgtcgcccaggctggagtgcagtggtgtgatcttggctcactgcagcctctgcctcccaggttcaaacaattctcccaactcagcctcccaagtagctggaactacaggtgcacaccaccactccctgctaatttttgtagagatggggttttgccatgttggccaggctgggctcagactcctggccccaagtgatctgcccaccttgggctcccaaagtgttgggattacaggcgtgagccaccgagcctggctggattctggttttagtgcaaaagttcccacctaggttcctaagcaagtgttatgcaaatgaaagactgaaatttgcttaattccaattggttgactcagctgggccctgattggttgatacaagtgagccctgattggttggtacaggtgagctctgattggttgcttcaggggagttctgaaagtcccaaagttaaacggaggtgggtgttttcaggaaactcagaggaagtatgtcacctttagctagcaaatgaccacttgattctattttaaatttaggcctagttaaccacttgggatccaccttgaaggattggctctttcaggttcacatttgtttacaatactgtggccatcattttaaggattgggtttacaggggcactggaaaatgcaaagttaacgcttgtgtcactttgcactgttgttttctgtcctctaggtggtctgcaaaggtaccagacaattagtgctaaagcctttaggcttttatgaaaggtctgagtccgctctcattttcatagagaccacagaaatactgtcatttgattggtgggtggctcaagatgaagccccctggccttgcaatagtaaaactctggtttagcaaaatatggatggaatgcatctgtcaattggtgacaagattccttcccttgccaagcctttatcaatggtgaccgagtgggcaggttgtctcaaggagaggagggtcctggctgtgcagggagcaagtgcataggctggccagggagattaggattgtaagcaaatgcagcctgagtgataagtcttagcagttatcaaaacaggatgggaaggagccttccttgccacatgctgctgctctgagaacagagtcttccgtatttcaagaaagattgttttttcagaattttagatgaacactgtgagataggtccctatttcttttttttttttttctctgagacagagtctcagtctgtcacccaggctaaagtgcagtggcacaatcttgtctcactgcaacttccacctcccgggttcaagtgattctcctgcctcagcctcccgagtaactgggattacaggtgcttgccaccacacctggctaattttgtatttttagtagaggaagggttttaccatgttggccaggctggtcttgaactcctgacctcaggtgaactcacccgcttcaacctcccaaaatgctgggattacaggcgtgagccacggggcctggccagtagatccctatttcttagtttgttcagaaattcaaagtcctaatgaggaaccctgaggctggggtatgtatagagacactagctcggatgcctgacaattttacctagaggtacatgagtagctgtgacatcccagtgtttctgggttacaagcaagtatttttagctattttctaatgtggacccctcttctgaagggcatactacatagccatgacaaaggctgaagtcccaagctctccatttaatgcagtgaactgactgcattgttgtaaattgggagcaagtttgtaggcaaggggcaagtttgcttaaatatgaagactaaggtgagccctactttaaatatgaatttaaatatgaagattatggtatatgccctattttaaatagtataggcttactatattttgtttgtttgagaccgagtctctctctgtcacccaggctggagtgcgatggggcaatctcagctcacagcagcttgtgcatcctgggttcaagtgattctcctgcctcagcctcccaagtagctgggattacaggtgtgagccaccaccacgcccagctaatttttggatttttagtagagacagggattcaccatgttgctcaggctggtctcgaactcctgagctcaggtgatctgcccgccttggcctcccaaagtgctgggattacaggcgtgagccactgtgcccagcctcagcctactattattataagggtaagttttctgattaagaatataagtgtttaatttctcttacaatggctctaatgatccatatgctaggaggcactcagggtgtgggctgagctgcatgagcttatgatagggcaaaccaatctttatctaaacttagctttaagtttatgggtatgtgattgtctctgctttatttttatttttacttttttttttttgagacaaggtcttactctgtcacccaccctggagggcagtggtgtgatcacggctcactgcagcctcaacctcccagccttagatgatcctcccacctcaccctcccaagtagctgagatcacaagcacacaccaccatgcctggctaattatatattttttgtaggagggagttttgccatatcgcccaggccagtctcgaactcccagcgcaagtgatctgcctgcctcggcttcccaaagcgctgggactagaggcgtgtgccaccacacctggctaatttctgtattttttgtagagatggggttttgccatgttgcccaggctggtctcgagcttctgggctcaagtgatctgcctgccttggcctcccaaagtgctgggattacaggtgtgagctgctgtgcccggcctctgctttagtttagaaacagataaagcatttgccatttttttaccagtaatcttttagtgtttctcttggagtgctgagattttcttggttgcttctaagctcaagagtgaagtaatatacaatgagattctggggataagcatgcttctctctctgctgggtctgtaatgaaaggtttgttaagcaaataaatggtgtaaatattatatcaggaaatgattaacacctacatagggaaagagactattcccaaacacctcaggaacaaccattgtaatcaaaaccattgtgttaattacaaaaatatctgtttattaaagtaggtctttaagttgctttagttgccaatacttcctgcggtcactttgtgtttgaaagtgataagttcgtgtttctttaaaaatactgtataattcagcccatattccctccaataagtcaaatttatagaagacatttctgtaatcgaccatattaacgagagactaatggcaactcggctgttaggacaggatatttgtttttcttcttgaagtcctagcagctgttttatcctcatattttgcagaaaggaaaaacaactaaaaaaatgagatgtgtttttaatgtgaggggaatgcaagctgatcactaagaataaagagaaatgattgcatttggcgcagttattgatttcagaaatgtctttgaatcatgttatatgcatgagtgttatgccaatgctttgtggcttcctggggtgacatttagggaatgtagatttagatcctacattttgccaaatataaattgcctcaagtattaagtcgttttctgaacaaaaattgatggtaaaggaatttatcgctattttcaacagttactagatgtgtgatcagagagttgtgtcaaaccttgaatttttctaatgttgtatatttagtagtgtatgctgttgttgaaagtataacctcaactgcaggcagtttcctagggaccattaatttgttcttaaagtatttcagtcgtgatagtcattttcttttgaaatgaaggaaaattttgatcattaagaaagaataacagcattttacactaaataaatgtaaagtattggagatttcttctaataccatataacttaggtttcttagttatattgaattctgtccactgaagcaattgactttgtgccagtgttccttttcaaacaatttattataaacttgacctgtcctttctcatctcatatctctcttcttttcctaatatttgttttcttttaatcagtcaatattgattttttttcattaagaacataaggggctaacatgatttcatcagcccgctaattgctttagtaatagaaatctgttggtccctcaaacatcaggggtgcagttttaaaaagaagtggtaactgattcttgaaccatatgtctttaatttttacaaaaagtctagcagggcctgaaactttaaaaaaattcgtaccattctcttccaaggtttaaaaaaaatttcatttttttatttttgagatggagtctcactctgttgcccaggctggagtgcagtggcatgatcttggctcattgcaacctctgcctccagggttcaagcaattctcctgcctcagcctcccaagtagctgggattacaggcatgcaccaccatacctggctaattttgtatttttttagtagagacagggtttcaccgtgttggtcaggctggtcttgaactcctcacctcaggtaatacacccaccttggcctcccaaaatgctgagattacaggcgtgagccaccatgcctggccataaatttttaattataatataaaccctatctacttaaaattatttgatcatattcaataggattcgtacaatcatggtgataattgttattaattattaatttaataacaataggtaacaactactgagcactcactatgggcctattttgaacgcatcatgtagattaacccatttaatgtaaacagaaaataaaaaagatggaggatggagtggagaattttaaatggagtaaagaattttgaaaggctattacagtgaatgaactgtgggcttgcgggtagctgggggtaaaataggaacaccaactggttatgcattttttgtttatctgataaaaagaaacatgagagctcttcaggcaaggtattttcttgttgttgctcaatctagaaagaatgtattatggaggctgttacgtaaatgacactaaacagcttaataatcagtgttgtcaacataatttcacatggctgtttcttctactgatcttccaatagaagatcaaccaaaacaacaggtgagaaagtcaggattttaggtccatggtgttgtcttgggtctttagactaaagaatcaaactcttcctgtctttagtggtaactgcttctttcttgtgtatgagttcatatctcttagtctctgagtcagggttctcctgatgagtagctaccaacaccatgatgacaataataaatacagccacctccagtggccagaaacctggaaaaagttgcacactggggaagcaagaacctgtgtactgaagccactttagaacttggaagtgaaataattggggtgagctggacagcatcttctcttcttcttcagcccctcttttctccttgccctgatcaactctgctctcaggactttgtacctggcactgagagttgtcatactgtcataagacctccagagattatggtttatcataggataaatgttttccagttgaagagatgatagaataacagtagtgataagagtaacttaggtatgttttacatatcacgatccagtcttattcacctgcatatatacatatatatatatatttttttttgagacagaatcttgctctgtcacccaggctggagtgaagtggcgcagtctcggctcactgcaacctccacctcccgattcaagcgattctcctgcctcagcctcccatgtatgtgggattaaaggcacccgctaccatgcctgactaatttttgtatttttagtagagacagggtttcaccatgttggccaggctggtctccaactcctgacctcaagttatctgcccaccttggcctccctaagtgctgggattacaggtgtgagcctctgtgcccggtgtgcatatgtttttatatggcttaaattgtggtatgtattactgggtgtatctcctgtttttaatataacaactgtaaaaatgcttttgtggttttatacagttaaaaattgcaaatgactgaataatattcccttaagttaatgtactgtaatctattatatgtaccacaaatggatatttagattatttttggtgttttgaatgtgtgtttttttgtgtttggttttatattcgaatacagcaatgatcattcctgtgtgtttggcttctgttgaataacttccttaagttcaattttatgatacatttctttttttttctttctttcagaaggttgaaaggaaggaaactttacccttatgcctaaagtctagtctaacatcagcacatgccaaattcctctgcttacaggtgtgtaggggagggaaggaaatacgaagttgaacccagggcattagttctgagagttcaggttttgttttttttttttttctctctctaagcacttcccaaattcaccctttttcttagttctggccaggaacctgcatctactctggtttttaaaaacctagttcagcaacattcccagaaacagctaaactgttggctggtgggagagtgggttaaacctgaactacaaattagttgcttgaagggtagtgccttttcttgtggttcttctgtccttttgattggaagagggtttcccacatgtctgtgtgtctcacttttaaaaataaaacaaaggaaagaaaccccaaacaaaacccttcctaaaacatttgtcatctgaacagaacttcctagaaagcagtgtcattgtttctaaaaggaggagctcgtaataaccctccattctccctcctctcccacttttttacaatgaaatgattctatgactattagttgtgaaatggcttaattcagtttcttattctttattgaaaataactttgctatgcctagtgtctgtctctggtcaaagggcgtttcctgtgtcattggcttccacggtttgtctgctttcagctttgtgatccggagggtacagtctcgccttttaaattgtctgcctcatcttttatctttcaacgggtcctggaaagaaatcatccaacggcttctttccagtgtcagtttttgaaagatccatggcttgctttattttgacaggtggttggtgaaagaggtgctcaaagggtggggtaaaggaggagggctatataagcggaaggagaggaaagagtttagccgcttcttttggggctgtctgacaaatggcaagtgattattatgctctccttttttttttttttttgttttgtttttgaaaaggagtttgccaataaagcctgaagttgggtgacagctgtatcctttttaggaccatttctatgtctttctttaccttaaaaggctggggcatccccaatggaaacacaattgggacatacaagatgcagctgtatagattaatttcctgtaatgaacaagagtgataagtcattgaaaagctaggtgtccttatcagtaggagctgtctcattggataagccacagggtccacgccagtgtggttatctcagatggtcccagggtgttcagggatatctcccagtagccctgatttgctttagccatgctttctttagtttatcccacctctaggaataacagattgactgttgactggctactagatataagatagtgcctctctttattgtacgttaatatttatttatttattttgagacagaatcttgctctgtctcccaggctggagtgtagtggtgcaatctcggctcactgcagcctttgcctcccgggtttaagcaattctcatgccttagcctcctgagtaactgggattacaggcatgcaccaccacgcccagctaatgtttgtatttttagtagagacggggtttcaccatgttgcccaggctggtctcgaactcctgacctcaggtgatccaccagccttggcctcccaaagtgctgggattacaggcatgagccaccatgctggacctattgtaagtgaatacaactcctcacctcttctaacctttggtagcttccctagattgtcgtttgtagagttaatgggcctttattatgccacaggagtgagaatgatgaatgtttccctttaagtcttctttctgtaccagactctcctcacttcttatcccaccctttccctgactctgcaataacgtcagctgccctcagctgagccctcagttcagcttatatcttgcttgatgtgcacagcccagaattatacaataatgttccaggtgctttgcagaaaggtagtagaatgtattcttttctgattcccatgccctccttgtgttcacgaagcaatttttttgggtattgttgactgcagtacatttaacagattaaagcctgttaataattaagaacaatatgtaaggtccaaatcgatttacaaaattaaccagcagaaaaccacagaagctccaacaatacagaactaaaaggatttgggatccaggccattcttttccagaccttctcttcttgttctatcccagtcctggtttacaagtggcctcttgggaggaaaggaagcgatcagtaagggtggaaaccaggagcaaaaagcagcccacattgcctttttgtactagaactgttgttaacaaagactgcttggaaagagggccatctgctgaggcagagaaagctttctgttatgaagggatgtttgttgcatggccttttagggattcactgtaacttagagccctcattagggaaggtgtctcaaactcataagcgtaggcagatgataacaacaacagcaataatcaaaatttgattcgggatgggtttctagaaacttgacagtatacatagcttttaattccttttactgaccttttcagaagttctaaaatattttctttccggtctgatgttatcaaatttcaatatttacactagactgtaggctgatttcttttttcctattctaagtggacacagctataacatgagcacataaacatcactgccaggcgggagaaagagcctttggggatcaggaagcctggatgctagtccctgccttgctgctgaccagctgggggatgggcattcagcaagtgagcacatcaaggtcttgttcccggtgttcatgaaaggagggcgttaaacttgattatattactaggatcctttccagctataatagtctgtgtttcactgcaaatgcgttgagagctgatgagatgatctggaaagataaggggaataagaggaaagctctttcctcattgcatatgtattcttgaatataataaaaccttgaaatgagcagttctgggtaactgagctttctgaatggtttttgtctccttccttgctgtcagctgtcattctgtactgctgttagcttgctcgcttttagcaactcctgtccctccttggaaacttcccttgtgctctttggaactatagcgttaagctcatcaaaactctatgccaagtcagtatacataaagctgtgaggggagggcttctcctatggctgtggtgcatggatttttggctgatgaaaccctttgggggcttatatttaggttccagataggtaatgtgttactatgttcccatttgtcttaggctagacattagttaatacgctaattcattatgaaagatgagtaggtgggtgagaggaggaaagggaggcaagttatgtgtacatcagaagagacctcattttagaaaagatcaaaaaaagcagtttgaggtgaagaagtaggctgtggagcttttttgagacagctggagttcgaccggtagcttagatcataacgagaacgctggcttgggtgtgcctctctcacttcaagcttctctgcttgaagttgcgcactgggaagaacatgctgcctcagccagtgcctggaatgttgtgcatgaacttctgaaagactggagaccctcctccccttatgtgagtgcatagtcgctgagtgtgaatttgaacccagcagttcttccttcagaaggttaaatgtcaaggcattaacattcagataagtcgtcttactcaaaatttgctttaggatgctcctgcccgaaatctaacacccatgagtgctcattatgttcagaagagtctttcaggctatcaggtccaacagcagtatgtacccacggtccgtggtgctggccacatgtatatttcatggtcacaacagagtcatcttgggtagagaccctgggtaatttccatcccatctttctacctttcccaatttgatgtccccctcttcccactccctgtactctacatatagtgaaaccagatgagctgtttccccaaaacagccgggactgtcttctcgtctcgcccgcaggcctttatacacgtgttcttcctttagcctaaattttgccctccctaattctgctgattaacagtccttctcatctcttgtagatctttgcatctgttttctcagatgcccatctggaaattgcttttgacccatagcattttgccatgaatgaatgaatggacattagaatgatgaattgttcattcatttattctgtaagcatttatcaaatatctcctgtgtgcccagctaggtgtcagttattagggatataagagagagtaagacagacgcagttccagtcttcaaggcaatattctaccttatattaaaattggcagctgggtgtggtggttcatgcctgtaatcccagcagtttggaaggctgaagtgggtggatcacttgaattcaggagttcgagaccagcctgggcaacatcatgaaaccctgtctctactgagaatacaaaaaaattggctgggtatagtggcgcacgcctgtagttccaggtattcaggaggctgaggtgggaggatggcttcagcccaggagatggaggtggcagtgagctcagattgtgccactgcacttcagtctgggtgacagactcgtaccctgtctcaaaaaaaaaaaaaaaaaaaaaaggctatgggtagctgtgctggtgctgaggcagaaggatcacttgagcccaggagtttggggttatagtgtgctagtattgtgcctttgaatagccactgcactccagcctgagcaacatagtgagagtccatctcttaaaaagagttggctggctgggcgcggtggctcatgcctgtaatcccagcactttgggaggccgaggcaggtggatcacgaggtcaggagatggagatcaagaccatcctggctaacacggtgataccccgtctctactaaaaatacaaaaacttagccaggcatagtggtgggcacctgtgtgaacccaagaggcggagcttgccgtgagccgagatcataccactgcactccagcctgggcaacagagcaagactccgtttcaaaaaaaaaaaaaggagttggctgttggttttattacttctacagggatgtaagctccttgaagccgtcaggcattatatcttgttcagctttataatcccctatcatgccttacatatagtacaggggctcagtaagtgttactaactcagtttggaaaatgcccagtttcctttccgttaagaaaagtcatacatgtccagaagcctattccaaggcatcatctttgttgtagcactttgatataacaacagtggttatgttaggctttgaagcacatttttccctcaacatcaagtggactaaaaacacagaaggttaagaccggtcactgacaggtacgtaaagggtcttttcaccgtgaagcttttaaagtaagggctttgcccatttgtggtcccaggtaggtgtatattctagcctgccacctaccttatggccagcattgctaaagtccctttagcaacaaatctgtgtatctatctattgaaaagatttgttgtcatctatggcatagaagagccttgcagaatacttgtcccataaggcttttagacaacacaaagttgtgggaaaaacagttcctgatccacctagttttgagcttaagtcttaacatgaaaataatatagctagggatgatttactctgagctggatggatacttaatgttagaaactgaagaagctattggggaactcaattcaagcatttgagccctatcggtgctgcactagagttaggaaaataaaaagctatgacctcagaagtccaatgtaccatgtaattaataatcaacaaacatttcgaagtatgattatgaaatgaaatctagcgctcatttacaggaaacactgcctctattacaaatgatagacttattgggtttatctggcattgcctgtcctttaagtcctatataattattcctaaacctttcaggaaagaatttgagcataatatcttaaactcataagctataattcactaacaaggttgaaatgaaaatctcatttagttttctgtgcacttttccttctttttttctccttccttctttcctttttttctgttttcttcttttttcttttcttttctctctctctcttcttttcttcctttttctgtcattgcttttctttggtgaaatgcttccaattctctactgtttacattctggcagacaactataaataagaaggaattaatatccctgcaaaatgctttgggacattattcgcagcatataattgaaacccactgttttctttcatgcagcattactacaataacaggaaatactgggagaccaaagtagagcctctcagcccaccctaaggatatctgtaggcctttgtccataaagccactttgctcttgtgaactgaggctgatatgctatagccaagtaagatttagtggatgtatgtgaaaacaggatcctgtcggggtacagttgaatcccatgtcagcacaggttgaaacagccagcttgctagcggtgtaggtattcctttttttatgtagtgaagattccaacttcttctgacaccagcatgtcaggtcgcatgaaacttcctgattcaacactcagagggagggactatgggcttctggctgcctcctccttcaagtattaagacagaaccttccctctaatgaccatgagaattagcttggtgtccaaaagcattgggtggattagcatgtgggttattttttcccaaaatctaattctgcataaaattggcttttgtctcaaaaccataaactaaagggattagaaactgggggtggggtagtagtctttgtactcagagaatagatacttttagttcaagtatgtcagagcgaattaggactattaatgctctaacaaaactgctagttattgagatggtccttaaaacaagggaggccagggggcatctgaatagacagatttctgacttaatagccatgtctcaggttgttctttagtctccgagaatatgcacctgcctcccatttccattaatgtcattaggagctgcatattgtatataatacagggtcatcagggtctttattgctgttctttgaaacagaataaaatcatgtccctttcattctatctgaaacattttgtattaaaattaagatcccttaggctttgcccaattacttttcagataaagtttcctgataatgtgcctagagcagttttaatttaaacaagcaaatatgtattctttgtttaaacattttcctattccatttgtgtccctggtagaatcatctgaaagaactgcttagaatctttttttttttttttttttgagacagggtctctttctgtcacccaggctggactgcagtggtacaatcatagctcactgcaaccttgacctccttggctcaagcgatcctcccacctcagtctcccaaagtgctgagattacaggcatgaaccactgtgctgggccagagtttttttaaattttatttttattttttatttattttatttatttttattttttgagttaaaatggactccagtgcttactgttaaagctatttaaaagccccctcctccctaggcccccacataggaaagttgctgcacagaaaacaaatatcagcaaagcctcgatcccagtcctgtccccttgcctagctggtattttggggctgtcctttcattttagcattagcctaataatatgtacacatgtataatacacccacaaatcaaacgttagttttggctgcctcactgttggggtggtgatgtgggaaaggaataaaagctcagcaattagatgacttgcattttaactagtattggaatgcctgttctgggttaagcttggggccaggaactttaagtacttaattttgatgaatctgttattaacttcacaagcatctcagagaggagtatttttatcttcattattctgatcagaaactgaacctaagtttctgtaactgtaaaataggataatgccttcaagagttatggtgcagacaaaataaaatgataatatacgtgaagatgctttaagcaccatatgtatgtgaggcattgccattattatgacaattacttctattctgatgataaatactttcaagtaaaaatcaaaagcaaattagccagactttttgactgttcccgatgtttaacaactgaattcttcggtgtttcttacatttcttctaagaccatgtagatcatgaacacttttatgctcttttccccatgtcccccaacctgacaacccataaaaattgccttgaagagtatatggcttgcaaatgtcactgcaagtcaccctgtttgcaatcccaagcaatactgagtccttgaactgaatgctctacaacaaatcaaaaagaatgccttcctgtgagatagaggctgtgttgtacttaaatatacttactttattcactcacagctggaaaggtgcaggacagtgataacgaggtaatcctagactcttggggacatcagttagttacctgtattaagatgcattttaatatttttgtacaaacagatgtgagttcattatgagtcctgatttagggttctctggctgtgacctgaggcctgtggaagtttcagagggcttctgcagagatcccaaaaggcagtgctttcctgctgggttagagactatgcagagagagtgtttaaacagagtccagcttgacagctagcacagatactctttctgttgtgttgggagccagtggtaggtcagaaaagggaacactggctattaagagatttgcaggaggcgtaagggaagggtttgcctgagatctgactgtcttggtagcttctcagcactcctttttacccttgaggtctttgatgacacccttgggaaatgatgcccgacctgggacctttcatggttcctgcttgtacctgtcacgctatagcccggggcctgagccttctggagccttccagaaatgcttcacagaaatgctccacatgtaccaggacaatgctcagagtctgcttttggattgggctctcactcctactcaggtaattgtgcatccttacgtaacctttcaaaccgaagactgagacatttatagcaaccctaaagttcctctcatctcctctttcctctttcaaagtttgaactttgagattctcaggggaaacaacttttttttttttaagaaatgactttaattcactgcaggttttaacaacagggtatggccactctcctgttttcatctgaaggaaatggctttgtttgacagagatccttaaaacttattaacttttgaaaaatcaatagcactattccttccaggaaaaaagaaaaagaaaaaggctgtatggctcctttttacaaaggagttaaaattgtcagaatttgttaggccttttacatttttatcttgcgcatagccatttgctctgggtagtggggattgtctagttcatttggacacattaaagtgtatgtctctgtgcatttccagttccctgaagaaaattctcgagttgtattgttacaatagtacagagagttttcatgtaccttctaccccaacacatgcatagcctcccccgtgattaccattccccaccacagtggtgcatttgttacagtcagtgaacctacattgactcatcatcatcacccaaagtctgtaagtttacagtagggttcactcattgttttttgagatagtcttgctttgccccttaggctggagtgcagtggtgtgatcttggctcactgcaaccttagcctcccgggctcaagcaattcttctgcctcagcctcctgagtagctggaattacaggcatgcaccacaacacctggctagtttttaaaatatttttagtagagacggggtttccatgttgcccaggctagtctcgatctcctggcctcaagagatccgcctgcctccacctcccaaagtgctgggattacaggtgtgagcccatgtgtccaggcaacagtagggttcactcttgatgttgtatattctgtaggcttggacaaacatatagtgacatgcatccatcattattgtatcagacagggtagtttcactgccctaaaattcctctgtgctccacctattcatcccttccttccatcaactcctggcaaccactcatctttttgactgtctctatagttatgtcctttccagaatgtcatatagttggaatctgtatgacattccatatgtcatatagttggaaacagtacgtagccttttcagattgacttctttcacttaataatatgcatttaaggtttctttatgtcttttcttggcttgatagttcatttcattttagtaccaaaattctcttgtctggatgaaccacagattcacctactgaaggacatcttagttgcttccaagttttggcaaattttggcaattaggaataagctgctataaacatctgtgtgcaaggttttgtgtgaatatgttttcagctcatttgaataaataccaaggagagtagttgctagatcatatgataagggtgtgtttagttttgttagaaactgccaaactgccttcaaatggctgtaccatgttacattcccaccaacaatgagagtttctcttgcgctataaccttgccagcatttggagttgtgagataccattacatgcctcactgttgttttcatttgcaattccctaatgacatatgatgttgaacatattttcacatgcttatttaccatgtatatatcttcagtgacgagttcgctgagaccttttgcctgtttttttgtttgtttgtttgtttgtttgtttttgagacggagtctcgctctgtctgtcgcccaggctggagtgcagtggcgcgatctcagctcactgcaagctccacctcctgggttcacgccattctcctgcctcagcctcccaagtagctgggactacaggtgcccgccaccacgcctggctaatttttttgtatttttagtagagacggggtttcaccgtgttagccaggatggtcttgatctcctgacctggtgatccacccgccttggcctcccaaagtgctgcaattacaggcgtgagccactgtgcccggccttttttttttttttttttttttgagacggagtctcctctgtcacacaggctggagtgcagtggcacgatcttagctcactgcaagctccacctcctgggttcacgccattctcctgcctcagcctcccaagtagctgggactacaggcgcccaccaccacgcccagctattttgtattttttagtagaaacaaggtttcaccatgttagccaggatggtctcgatctcctgacctcgtgatccacctgccttggcctcccaaagtgctgggaatacaagcatgagccaccgcacccgacccaccttttgcctgttttgtaatcaagttgttttcttatgatcttaatactttttcatcctatgacaagtgttaatttggttagctggacattttggttttgattacatattccatttagatatgtagggcttaagtcagattatgccaggtatatgttcccttgggcttgctgaaggattcacttttattaacttgattctggtgaaagggcgtgtaaaaagtgagactgatcaactaaatgtgccatttaacccactgaatgcacaaaccttgcaggaaagtatagtcagttcactataacacaacatagtcatttctaaaaatcaccatgctatgccaaattgtgtggtaagacaacagtaggcgttatgggaaaattggggttagggcacaacactaacaaacttatccactgacacattaaaaaagtaaaaaggaaccaaagaaacttaggagcacagtttcacacatgctaaatggttaagaaatacacaaatattgccatacatatggcatgtgaccttgaagacatctgaagtttaactgtggacagggaagtcagaagggttccagcttgtgtgagttattatgaagtggtggatggagagttatctgaaatctgatggaaagctgtagcactaactgtggagataggggtggctcataccactggactgagggagctggtggatgtttaatatatgtgttttgcgtatttctacatggctgggtacagctggttgcggtttcctgcattcacctcctatttctggaagacaagctcacgcataaggaaacgtgaaattttcattatgctcaacttcttccttaatatatcaattgcattgaaacaaattcacattttcaaaataaatgtgatagcataatagactgtaactaatatcctttgttgcattcttgagcatatgttcctttcatcctcatagtagctgctcacgtatgatctcctttgtatgtgctgcccagaagtgttggtatctggggcccactgaccccggttcttttatcacctgtccattttttctaccatgtgcctcttgtgctgcttaggagggccagttagtatgcaaagagtagacttctggttctatgttgagggaggagtgcagggctggtaagagctattgcttactaaaaattgctggtgtggatgaggcatccgccagggctgagctctagaaggattatctggagcttgtctaactagggctcactgcatatttgagccctcgaatggactgtcttcataaagtaattaaaagcatattggaagcacatcttctttctaatctctggcattggatcttagcaggactgtattcagttgtgtctacatctgttttgtgtgcaatttgcctctcacggattatggaaaccatctcttgctggggaagctttcagtcgtgttaaagactcatttaccaagggaaaacaacaccttagaaaggaatttattttcaaaaatagacatccacattgcatataaatgtatatagataagtgtttcaacaacaacaacaaaatgctgcccttctgttccaggaaataaataccttatattcagtttggcgggagggattcttctcaaactaaaactgttctcctctatgtatatcatttcctgtaattccctcactaaagacgctttggattcagaggggctatattattcttggaaagttttggagttttccaaagattgactgagatagatccttagccttacaacttcttgccatccaggaactgcatcacttttttggggggtgggggtgggggtggtgcgggcagacagagtcttgatctgtcgcccaggctggagtgcagtgatgcgatctcggctcactgcaacctccgcctcctgggttcaagtgattctcccacctcagcctcccgagtagctgggattacaggcacccaccaccacgcttggctaatatttgtacctttaatagagatggggttttgccgtcttagccaggctggtctcaaactcctggcctcaaatgatcctcccaccttggcctcccaaagtgctgggattacaggtgtgagccaccacgcccggcccacatcacatgtataagactccactgcttgattaggaatgggaccttggagttaggatctggcactttcgaagtttttgtaaagaaaattcaggactcctcagtctccaggtcaacgaagtccagttttcatgttattctgttattgtttgctatttaggattgctgtagtctacagagatgtaactgtttgaggtggaaaatagaacatatggtatttttgcctagagagcgagggcagtggtttttattcttggctgaccaattgtttctctttcttaagcactttctatgtgccagcattgtgatttttatgggttatctcctttaatcctcacaaaaccctgtaaaatgacccctccctcactttccatataatggaactaagacttctctaagtcacttgcacaggatcagtcagcatggatttgaacccagatctttcatttttaaacgatttcattttttttgttgaaactcacataacataaaattcaccatttcaaccaacttaaagtatcagtggcatttagtatataaacagtgtcatccaaccattaagactatctagttctagaacattttcgtgacttcaaaagtaaaattctgtacccattaagacaccacttctcattcctgcctccccccagcccctggcaaccactaatctgctttcagtctctctggatttgctcattctagacatttcatataaatggaatcatacaatatatgacttttgtgtctagtttctttcacttagcgtaatctactggcactttattcccttcatggtggctgaagaatattgcactgtatggacacaccataatttcattatccattcatcagttgatgggtgcttaggttgcttctgccttttggctatggtgaatagtgctgctgtgaatgtttgtatacagctttgtatgtgaacacctgttttcagttttcttagattggaattattgggccatatggtaattctgtgttttaccttttgaggaaatgccaaagcattttccatggtggcaactacagtttacattcccaccagcagtgtatgaagtgaacccacgtctttctgactccaaagtctgtgctcattttcttaggccatgccatctcctcattacttctcaagggccctagcaattgcctgccaagccacacctccagccaacaacagaagcatgctgcagggtgtctcatgttgtgaggggatggtgttggtaatagggctttttggcttggtgaaagaacatgtgtcagagatttgtcagtggacaacctcctcttcctctgtgtcaggtaatagttaagagtatgggctctggaaccacattttatatgattccaattctttgaaatgtccagcataaggaaatccataggcagtaggatcagtggctgtctaaaatttagggagtgatggttaagttatgggatttctttttttttttttttcttttttttttttgaaatggagtctcgcactgtcgcccaggctggagtgcagtggtgtgatctctgctcactgcaagctccacctccagggttcacaccattctcctgcctcagcctcccgagtagagtagctgggactacaggcacccgccaccacgcccagctagttttttttgtatttttttagtagagatggggtttcaccgtgttagccaggatggtcttgatctcctgacctcgtgatccacccacctcggcctctcaaagtgctgggattacaggcatcaaccaccgtgcccggcccccgggatttctttttagtgtaataaaaatgttctattaacgcttgtggtgatggctgaagagatggttcaactttgaatacactaaaaaccattgcatgggctgggcatgatggctcatgcctgtaatcccagtattttgggaggccaaggtgggcagatcacttgagcccaggagtttgagaccagcatgggcaatgtgacaaaaccctgtctctacaaaaattagctgggtgtggtggtgcacacctgtagtcccagctactctggaagctgaggtcggagggtcgcgtgaacccgggaggttaaagctgcggtgagccatggtcacaccactgcactccagccagggtgacagagcgagagcctgaatcaaaagcaaaaaaaaaaaaaaaaagaaaaaaaaaaagaaaaagaaaagtatggtatactttaaacagatgaattgtatggtatgtgaattatatctcatgaaagaattttttaaagtgtagtctctagagcctcactgccacttattagctctgaacttggacaggttccttagtgactctgttccaggattcatgtttaaagggggggaggataagataatagttctgtacctacctcattgagttgtgaagatcaaaggagctaatatagataatatagtgcttggcatggtgcctgacacataacaaatgctcaatgcatgttgttaactattaatataagcatcataaaatatttttttgaagttccaactgatggatggtgttcatgatagggcagcaaagactggaaacacatagcattcctcttaaaatttaaattctttgttcaaccctgctgccaagggaaatgagcactataggacaatgtaatgggacaataatttgggtagtactgggagatgaggtcatatgggagtgggtgttgggtacacttaagggctgaaaaaagaactggtgctgttgcatgtgaggaaattgtattaaaaaggctgctctaccctcactgacaacagatgttgggaggtcttaggctctgggctccagggcctctgacccccttgaaattctctccaggttctttggaggtcatgatcccacagttggcagagccctggtgtagattagcttccttggatatgttttcctctctctttccctaatgcctcccatcccgagggtctcgaggaactagagggaggtgcttatgctagtaaagaaactagcaccttttcaaggaaaatgaaggaaaaagctgggacagtagggaaggcaggagtctgacccatggatctaggagtggaaaaagaagaacaaaacaccaagctgttctgcttgtccagttgctctgaggttgaaggccttccaggagaagcgtcctcactgttgtctgtgtccatgtttgcaggccacagacattgactatctgcccggtgcctccttgtcaatgtcccatgtgggggagagacaaaagcaaagacagccagccttcccagttccttcaggagacagaacccgaaagccaacacatgaaggcatggaagaacacttccagagaaccagctcacaagtgcaaggggatggggctgtcgaccccgtgtgtatagtgccaaggcaatccaggtcatggttgcagagtgctttactgccatttttattgcctcctttcaataaaccactgcagtgcatgaactggttgtgttttatagctaggaaaactctgagctaccaacacattaagttacttgacactgagagaaccctcaacatgaatgtcttatatctgcaaggatatttgtgttagattccatcatggaggtaggaatgcttatatcagacaaagatgcatatgcacacatgcacacacaagcacacatatgcatgcacacatgccaggggataatgatgtcagatatggggacttaattgctggaagcgagtgtaaaatgccattggtgagggctgggggacagagagagcagccctgtggccctgggtggcaggggagagcccggggtaggttgtgtgcctccctccccaacatacacagtgcccttctcagcctgctgtctgtccattagctgcacggctgctggcctgagcacacgggctcttcttggctttgagccagtggcgagctgggagcctgtgactttgagacttggcccttttcagttttctttgttcagaaaaaagtttcatcctggctgtcttcagtggctgccgaggattaggagaaccctggggagacttggctataggacggctctcaaagctgtgctgggaaatttgaagagggcccatttctctctgtcttatttcaagttacattcttctctcccttcctaaacgagtttttactgttgcaaaccctactgcataatcccctagtgtacttttgtgattctgctgctatggaagggattagaccagtatcaggaccagtaacatattttaaggactgttgaaatggacagtatgaagtaaggttcaaatttggatactcattttaaatagttgcacaagttagaggcaccacatgctttcctgggttagcatttgtcattcttaaaaaaagaaaaagtatgcttttcagtggctggaaagaaaaagaaaggaggaggcttggctcctctgagcagagcatgagaattggatttctaaatggccagagactatggtattcccaagtacaagtggtttgttttcaaaaatttgtaactacttgcagttttgcttgtttaatattgttaagaaatggaaattgcctcagttgtaaagtggttttcccattaaggattttttctttttagttttgatggtttttaccttttaaaaatagtatttatttcatgattatgaacaaattgtttttgcaaatctgattgtattacagtagataggtagatgtttgcatttttcataagctacccattagtgtaaatgtacaaaaaaatgcctttatacatctttttaccatgtttcttgtggtacttggggaggacttaactctgaactgcctccattagcattgtttcccagaggacacattaacagatcaaaaagctatagactactacatatacacataccaggagtacgtagttcagtttctgtaatcccacagtacgcaaatgttggcagaatttcaatgattgtattaatcctgtgagatactttgtcatgcatgatagatgatatttacaaattgaggtctgaaatggtcagaagctttgaagatgctttattgtgcagtatgtggaagtggaagtgtttatattgttttagaccatattggccaaccaggcagcaaaaaatatacagtctcataatagagtacaacaatttcataacaaacctgaaggttgctggggagtttttccagcctaaaccaacaaggttcatcaaaagttttgccaaggtcttaaaaccctatggataattggagcgtttggatatctcatgtgaaacacaaatccatttaaatgccatccacatacctgtgaaatgactttcttaatacatttctgtattgtagactcagagcagaatatgatagccctgctatgaggagctcctggttctttaagggctccacttgattaatcagagaggatctgagcataattaagaatcacattgtatttgaagactgggaagtgggagcccaagaagggtcactgattttttctcaaggtcatacagtcagatcaactcacgaggtcttgtttcctctctacatgtataacagactgtaggttgcttttgcccctttcacccccaactcctgcgatttaacacttttaaattttgaaaggtttccttacttaaagaagttcttggttcaccctggccctactctttgtgactttgcacatttcctttctctttccctacctaccttccacctttagtctgttcctcccactgggcttctcccttcctattcctttaatttttgctgcccttctctaaaacttttcttcatagtgttcatgagtttgagaatagcacatgtcactctaggcacaagcaaattactcttttgtataaagagcaggcttgtttcatccctttggtggctatgggttttctcagactctcccccacgttgccaaacacttgcagctcagcactatcatggattggtgtctttcccccagctttactgatatataattcatatactataaaactcacctcattaaagtgtacaattcagtggtttttagtatattcatggagttgtgcaaccattacctcagtctatttagaacatttttatcacccccccaaattaactgtgtaccattagcagtcacccctcatctccctccctctctttctgccctaggcaaccattaatctgctttctgtctatggagtgatgttttgagggcccagtctacaatcacttccctgtgataagaggagtcatgtggctactcacttgctcaccttgacagtggcctgcctgatgtttgctcattttcctccattaatttgacatgtcactaattactttagtgtcaaagttggagatagtttacctctcctttcctattctagagactccagaaagggaccttggacaaccttgaagtgaattgcctttctgatctctgactttctacaaccccgtttttggcagatcatcaactaccctttgcccctgagccctggtgatgggaaaccccaagaactggaagttcccttgaggttgggattttgtaacctcagcgctgagcctgatgcctgcctgcctgccacatagacactcagtgtcactgaatgaatgaacttaagcaatactgttaagatggaattaccatacctttttgacacatctgtcactatgaactaattgagcttatttatgctctgtgtgtgtgtgtgtgtgtgtgtcttcaataacccaactgtagaatcattttaaaaatagcaagtaaagctgatctcagaataaattctaggtgcatcccatcttgtgtacgtagcagaaatggatgcatttctccctaccttctgtttcttgtgttgtatgttcgattcctatccaggagaaaacaagatgaggctttatgttttagggaagaaaatggaaggtttagagaacatgtttttatttattgttttctaaaaatgctatagaaaacagtactccaagtagctgttttgattctctttaattcctttcttcttcatctgaggatgaacatctggtagggagtgcttttacttgcaatccagtacactcctattgtcagtccaaaaatatgtggaagtaaagagattccatctcagacccctccaattgccataacagtgggcctgatatagaagttgagaaggtgtcaataaagtgttaatggagatactcaaggaattcagagcatttcaaggcacagcatatgttcacatccctctggtatcagcaaaaactcaaaagtgaaacctgtagggtcatttggctttcatgctgtccaacaataggactttaaaagccacacactaaggagcagaatattgaaaattactttgaactttcaaagctaactatctaaaatatcctagcaactttcaaaaagtgtgataagcaggaagtgcagcactttgtaagacacgtgcatgctcttaagcagaagcctaaaatgctcctaatttgtaccagagaccttatcaaagggcttcgcaaaattccagttcagcaattatgaggtattagttgagtttaacctctgaatcatagggtggggagtggagaattgtcatttcattctactttcaactatcaaggcagatggacctttctaaaagatggtggtgggtgagtagaaaaggaattgataagaaaaaggagggactttgaaagggcttctcttttcagagctggcatgactgtctctccagtactctccctactacacatatttctgttttgtaaggagcccctaaggatacatatacagatatccttgggggctccttgcaaaacagaaatacctttggaaagttaaaagaaaaaatggggtttcctataacctcttttttttttttttttttttttttaaagacggagtcgctgtgtcgcccaggctggagtgcagtggcacaatcttggctcacagcaacctccacctctcaggttcaagcgatcctcagcctcctgagtagctgggattacaagtgcctgccaccacacccagctaattttgtatttttagtagagatgtggtttcaccatgttggccaggctggtctcaaacttctgacctcaggtaatctgcccacctcggcctcctaaagtgctggaattacagatgtgagccaccgcgcccggccttccatacctcttttaagctgttgtcccagggtctgggtggagtggcttgtgtttgggataggagcagcactcatttcaatgaaatcacctgcagaccttggctccattttagaatgacttagaacgtcctgagaagtaaattgcttatcttggggcctcagtttctgttggataagttaattgcctctccctatgaaaaacattttaagtggtataatggcctaaggtttgttatatttatattaacgaatttggacaaagagaaatcaactcaagcaatttttttttctgtcaaagaaatgctatacccattaaggacaaattttgtgtataaagatggctttatttatatttagaaatgatggctgcaggcttttatttgatgagtttgtttagattacaaaacctgagcatattttagcatcagggcaggggggctgctgatctctccaaaaagacaacagtgatttgagtaaagcaagagtttgtagtaatatatgtgtatgtgagtttttaagttctgaaatggatagtaatttaaaataatgaacaccagaattcaaaggactacatatttgccttaagaaaataacacagagcaaattgcctcttagcgatttatagttttatactttgtcttgtttgttccactggtcatggcaaactctgggaagagattttgaggctagtctgagccctagaagtcaagaataaaagtagacttttagttaacagtttaaaactttgccatagtttccaattacatttatatttgaacaggaaggagtcttaggacttttcttcatttcttaatggtgctcataaaacatagtgaatgggaatttgctttaagactaattgtatgtgtgtgtacgggtgtgtgtctgggtgtatacacacccacagagacgcgcatattaactaagttgggatgccatagttggatgagttttcaaatattttagcaaaggtttctgagcactcatgaaacaaaagcattaaggattgcttgtcatagctaataaagttttcttggatctcacttaatttttctgcttcacttcacagagtaattgaaacttcctttttgctttgagttcccctcaccccacccccaagagctacagtcttaaaaggacatctcttttggttagcagttctatggatttttttctgaatgtagaactaggtcctcaaatagttattgagctagtggtcattcaatccttagaagggaaattagttaaatctgtaagtggcttctggaggttgaagaacatccaaggagaataaaggcttattacaactggagcatttcaagcatctgttgtgtaagcctggaaatgtgatccaggttgaaaagtagagatgatggaactgttccattggaacagtgaaggtatgaaaaaataagctccaatctcaaaaacaaacaaacaaaaaccctgaagaactttataagtataggaattatcagttgatgcagattagccaaaatgatgaggttttcctgtgctccatcaatagttatttgcttctttatttcaaatcattctctagaaaattgtctttctccatcaaatgaaataaccttggaagtcttaaccaattcttgcaaaatggctcccctctgtcttccctccagccatgttttgttttgggttaacagtaaaagacaaaacagattgttgactttttgccagaaaattttggggacagattttgctgctgttgcttctgacgtgaacaaaaacctcagattgcatatcttctattctcagggcaaaaacttatttttgaagcaatgtgggtgggttttgaggcgtgctcttctgtttttgttttaaagcatttggtaagaagacacttgactttgaaattttattttcatatgtactggcttgagagagctgacctcccacctccactccatctaccttgtcaactttgatttttaacgaagtaatcaactagttgatgtaacatgcttattttaaaagcaatcatatgggagtgatttaacctttttttttatcaagttgagtgttaattattttgatctgcctcttgaatggtgggttgttaatagtaatattagtcacagctggtatgtgagtactcaactccagattccttggttcaatatttcataggtcattaaacaattttctgatgaaaatgatttatttaaactccaattctcaacctcttgcttttcacaatcccttaggataattaaatgcccagtactgcacccctaactagttacttacttttcaagaatcctcacttaaataatcatatcatatgcagaaataattatcctgcaaagaaagctttgtgaatacttcggtgtttaattcagtttaaattcatttaggagagagtagtacaaaatggctgcattataattcacattgtgagcaaagtatttttaaaatattttgacattcttgactaggttttcatgtcactctttatcaaatgcatcgtactactatattaggtttctttgcttaactcacactgtctaatgggaaaaagttcaatatcatttaagacagactctagttatctcatttgagcgacaattgttctgggggaactgtaacttaacagaaatataagaaaaacaggaactagggtcaaaagccccacagggtataaaagggtcataacctctctcagaggaggcaaatgtaactgatatactagtttttaaagggcacttgattgcatgaaggaatgcagtaacaggatttaaagcaaacatacagcactaacaaagattaaattaatggtgtgccctgctctggggggattaaaagaggtagttttatataaaattattgtgagtagactaagattaatttcctgattttgcatatcataagatactgtaatttatgatatctgctgtgattcttacgtttaaagtagtacctagactttgatatgcgaacaaaattaagaaaccatgtcaaagtataaaaataatgttactcggtcgggcgtggtggctcaggtctgtaatcccagcacgttgggaggccaaggcaggcagatcacctgaggtcaggagtttgagaccagcctgaccaacatggtgaaacctcgtctctactaaaaatacaaaaaattagctgggtgtggtggcgggcacctgtagtcccagctactcaggaggctgaggcaggagaatgtcttgaacccggtaggcagaggttgcagtgagccaagattgcgccactgcactccagcctgggcaacagagctagactttgtctaaaataataataataataatgttactcaatgttatattgaagtaatttttctttatattcttagatggtaaaattaccatgctcttaaaaaaaccttaaaagtgaagttctaagtgaatcaacacaatttttagatgatatgtcatgagaacacaaaacacatagaaaaatggtaaattttattaacagtgcttttatgaattgaaaaccttcccttagtgttggatacggaggctagaatgaattccacaatcaccgtggatgtttggagtcctgggaaatgtgctgcagagctgtgtaaatgaagtgttgctgcctccaaggtgtcttgggcctaggttggctatccacataattgaaattaaagtaaaacttcatatgctgccaagaagacaacaacacatccagttaatctccaatagtgttttaagatgattcacaattggaagataggtaacatggtgtttaacaggtatgccatgttttttgtcattttattcaaaagaatctcagcaaatagataattttctttttacatttttaaaaaagagatggggtctcactttgtcacctaggctggagtgcagtggcactgtcatagcttgctgcagcctaaaactcctggcctcaagcagtcctcctgcctctgcctctcaaagtgctgggccactgtgcctgccacttttcttgaaaaattataggtaaggaaaggggctcattgttccagtttcgcctagcacagttcagctttacacctgctgtcctagcatagttgttattgttcttgtttggagacagagtctggtctggctttgtcaacttacccggagtgcagtggcacaatcatggctcgctgcagcctgaacctcctgggctcaggtgatcctctcacttcagcctcccaagtagctgggactacaggcaggcaccactatgcccaggtaattttttaattttttgtagagactgggccttgctatgttgcccaggctggtctcaaactcccgggctcaagcattctcccgccttggcctcccaaagtgctgggattacaggcattagccaccgcacccagccctcagtataattgttagtggcaccttctttcactctcccatgtgtcctggtttggcctataatttgtggtcaccctaagaacaggaaacagtatattcacagaaagaacttgctaattaaaaatgatttaaaatagttttgcttaggaagaaaacattatgagaactttacattttttcctagacataacttagcctaaggttgaggaaggagacaccatcaagtcgatctcctggctaagcaggttacatatacatcgcaagagcactttacaaagaggcaagaaagccctataccccaatgtctgaaaaggatcacacagagtagaatttaatctgattttgatggtgttaccaatggagggtattgactgcaagttgtctgagttcttggcgttttgaacaaaggattggacaaaactcacagcaaagcaaggaataaaagaagcaatgaaagcagagatttattgaaaattaaagtatacttcacagggtgggagccacctgagcagcagcttaagggccctggttacagaatcttctggagtccagataccccctagaggtttcttactggccacttggtgtacaccccatgtaaataaagtagtggctggcaatcagaggctgaagtgaagttacaaaggttacaccctatacaaccaatcagaggctaaagtgaagttacaaggttatactcctatgcaaatgaagacttggcttgcaatctgattgattgtggaaagcaaccaatcagaggtactttcaattttccatctgccactctgtaagggatgggggtttgcaaagggagtagcctctctggtccttttgttacttaggtgtggaaagttggggttttcctttcaattcaccgtgaattggccttaggttccctgcctccagaccctattctcctgcctcagtggcacctcagggccatcatttcgaatatcacttacttctaccctggctacacacacagatgcagtaagaggccaggcccacagtctagaaggaattgttcaccatcctattataaatcattttgataatttttcttaagtgcactggcttactgaggtttacctgccactttttctgcccacagagtctcacaagctggcctgtgttctgttctctgaagatcccatgcactgtagtgcttagtgctggctgtagtggagcccaaccttttgtagtctgagaaaaccagtggtgtgctctataagtgagacagtattcagtgtgcagaaggtacttggcagaactataaatccatagacttttggaaatatctctaagatccataggctgggaatcacagaactgaaccattgaaaacatgtgtgtgccattatgtaataacatttggagctttggtcttggaacttgatattatgatctgacatgcttttacacttgaatcatctcagtgcatacctgattcatgccttcattacatacttttgacctctgaaatccatgaagctgataaggacttgggaaggctgctctcatagcatgtaaacacttggaaggctgatgaatgttctgctgtagtgttatatcctttctgtccagctcttgagggattgcttattaacatttcattatccagtcatctgccatttctgttcttactgactaaaaaatgtgccctgtaacctaacatccagtataggacgttgctccatctttttgcaaagaaaagtatgtgaaacaactgtaactatttaggaaagatgtgtaatgcagaaaatagtgcatatttgtaggttttaacaggcttatttcctcttctaccaaaaactaaagagaaatcagtctgcaggtttagatctttgaaaataaatgcattctaacttttatatctttaatagagattcctaagatgttagtgttctgaagcatctttactatcattgtttgcatccagcatcagattaaaaatcaaataatttgagtgtgatagagctgttcgttggagggtctgcttgagggtagggaggctcaagagacccagatctgaaactcagcagcctctcaaataggtagttttgacttgggggcttggcaaaatattgtcataactgcaatggaaatggaagtgagaagaggtggatttatggcatgatccacattagactctgagctccctgagggcagagaatgtgctcatttttatctttagcattttgcactgtacctgatgtattctagttactcaataaatgttggttgagtgactagagaaagaaaagaaagttggtgaaggtcgaggcaaagcaaacactgtagtggtgaacggttgatgaaattgtcataaaaagatgaagttttaaaaattaggtggaaaccacagggtgtgtctacaggcagccaccaaaactgcagttgcaataaaataaaacattaagaaaaaaaaattgagaagctttaacaaaaaaaacttacttggctttggagctaaaattccacagctgtaatcagggaaaatgctctgcccagcagcctgagtaatgaataaaaagaattttcagagagaaaagaaatcaacaagctctgtgactccccccagaaaggccaattgctgcctcccaccatcttttgacaagaatgacattttacccacccatgccaggcttctaaaataagttgataatgtttgcactcgctgtattagtagaacatcttgatatagaatgaaacagtcttaaatttcttagctactaggaagcacgttttttagctgtgtttggaacagtgagtattcttagattttcagcagcattcgtgtctagatatctttggaataatttgttgtgttctgatcctgagagttgattatgtgttctctttaccatttctgaaagatgtaattcacatgaaagttattaaacagaaggttatctgattcttatttactatttcattctacttttacaattatgtgtgtatattgaagttcagaatgccctgtctaaattttaggttgaaaacaggaagtagtgactaaatttaagtgtgttttcttatttgagggattaaaacccttgttttggagtttgttttgttttgttttggtcatcacttccaatttaaatgctattgttgtttctggttgcctgagcagtatgaaacatcagcttgtggagaccaataacttgtgttaagcttaaatttgaggccagtccagatggaattcttcactccagaatgtctgtgaatggcatttcctcagaaagtgtaacagaatttttggtccgtatgaccaagcaattccattgctaggtataaacccaagagaattgaaaccctatactggggtgggggttgggactcattctaactttggaaattcttgagattttagtgttctaaaagggtttctatatcaaatatatacagcatcagaataaaaatcaaataatatagacatgttggtagcagcattagtcacagttgccaaaaggtggaaacaacctaaatatcaatatcaactgttgaatagataaacaaaatgtggcatacccatgaaatggaatattatacaaccataaataagaatgaagtactgatacatgctacaacatggatgaaccttggaacactatgttttatgaaaaaagccagttcagaaagattacaatatgcatgaatctttttatgtgaaatgtacaaaataggcaaattcatagagacagaaaatagattatgcttgcccagggctggtgtgtgtgttggggaagggttggaggggtgactgctgataggcacaggatttctttttggtgtaatggaaatgttctgggattagatagtggtgatggttgcacagccctgtgaatatactaaaactcaatgaagtgtacactttaaatgagtgtattgtacaatatgtgaattaaattttaaaacatgatgggggggcaatttctggagaggggagcaagcaacatgcccagcaggacattattcacttgagtttcagatttgtagtactctaatgctaacagcatggtttgcctagctgatgagggttggggaaaaagaaaatcaaaagctggaccacaggagaccagggttctcgtcctgatcaaatgcatttctactgtgcaaccttgtagatagatgttgggaagagaggaatgagaaaaactgtatatccttttcataattaaatgattgagagtgtttggggaaggacaagagaaaaaagagctgtatgtttaaaaacagaaataggccaggcaggtgtggtggttcatgcccgtaatcccagcactttagggtgactgaggcaggtggatcacttgagcccaggaattctagaccagcctgggcaacatagtgagacctcattcctgcaaaaaacaaaacaaaacaaaagaaaacaaaagcactaaaaataactaaaaaatgataataataaaagattttaaaacacagaaataaacattcctcagggcgaggatgtgcatgtgtggttaattcctaatactgaacaaggcagggttttgactacagcttagccagacactccttggcctctctgccatggcattcccagctctctgtcagaatagcaaatcgtagctgacatttgcttttccagaaggaacacccttttgccccattctaccgtcagcctggcttttttgtccggatttacctgttctttgtagtgggagacagctgtgcaatggatgggagcttgagggagcccagaaacctcttctaggaccacagcagcactcattcatcactcagagaggaaacaagtagtttacgagctttcactgaaaagtcatcattgtgtaggttttcatgaaataaagattgtgtgagccatcacacagggctgttttcaggacaactctgacagaggatgtttgttccttccagaaatgctggcaatattgtaagcttttcatccctttaccagggcattactctggtgctgttagtgtctgattctgctaagaagtaggaaatgttaagaaggcattgttctaaagaaatgatccccaaatatcagtgctaagtgccatctatgaccacacacatgtccatttataaaatgccttataaactgggagcagtgctgggtttatatcaaagttcaatctcaaaatcaatgccatttaaaattgtaaaaccattcttaacttgttctttcaaatgtagaacatttgtattatgtttatgttacatgtagggcacagatatggcatgtgacatttggtacattgacatttttagaacaaaaatgagtgacccactgtttttccttgcctcttctgttcccttctctgtctgtatttttccttcctctcctctcctcccctttccttcctttctttttttttttgagacagagtcttactctgtcacccaggctggagtgcagtggctcaattacagctcactgaagcctcgacctcctgggctcaagtgatcctcctgcctcagtctcctatgtaactgagaccacaggcgcaccccaccatgcccagctaatttttaagttttatatagagacgaggtctcaatctgttgcccaggctggtcttgaactcttgagctcaagcaatcctcccgcctcagactccccaaagtgctgggattacaggtatgagccattgcattgggccttgtctatatttttcaagctctttgcttctattattgtatttaatttgttttggagtttttttcttactcagaatcctgcctcctcattctttctctttttgagagaagagcaacttttgctttcgggcactctaatttacaggaaaatgaacgatacaatttatgcagttttgtgttctagaaaatttattatttcagccttcagggttacccaggttttgtatcatttcatttccctggagcactttacacatttaatggcaaagaccagcaatggtgcttttctggtgtatgcagcagcttgttctaaggcatgtggtttgagagttggcgctacttaatcatcttgtttttttttttttcttgagtgttttggatctatttcctccattgagtccaagttgtcttgagagaactcaagaatggtgtgaagtgtatttagcagaatctctcttcccaaatggcaaactgtgtttcaagaaataaataagcccattctaagatataaaccctattttcatgtttacttagctcttttcttctatatcttctgggattgatatttttagtaatatgaaccagctatttgatgccctttgaaagtaacagccttgctgcatgggtcagttttctggtagcgtatcaccagcaaggacatcacactcaggtagaagaaaaatgaatgttcttttttggaatatttcaaaggttataaatgtatatcaaacaaaccagttttccttaataaatcacctcttaggtctgttttctctaacatctagaacttttgtgaagctgttaagttgcagcctataccaactgttgaccttttgcttatagctttaaaataatgtcttagttatcttacttcatatgaaaagaaaatgttatgagtaagagatttttcccttacctatcaaactgtcttttaaacatgttttaaatatttcaatgaaaatatttctaaagtatttattctcctaacttattaaacagaaggataaaaaccgtaatcagttaaaaaacactcagggtcaccattatgagaatcatttaataaatgatgctctaatgcagcaatgtccttagggctctttgaagtatgaggaactatttgcccctaagctaaatggccccagactgttctgctgcagttgcttctgccttccttttcagctgtcacttctgctgtcattgatttgggttcactctttgaccctttttaacccagtgcagaactgaatgtctagaaatcagacagtagagttggttaaatgtgcaactggagtatttgtgtacaaaataaaggctatgttccagagggtggcttcagtctcctacagtaaatttcacagactttgaatatttcttcttcttcttcttctttttttttttcggcaaacccaaggcttcccttgcttagtgggtcatcccacaatttgaagtaatgtataagcaagccattgctatacttctagggttgtttattgaataaatttagtatatcaataggtgataaaagagacaaccattttaaagcctctccatatgtttgattaaaagaaataatattcctgtctttgcacactgaaccttaatctattttcatttgtcttcataacctcttataaagcaaataattgccctgacctttttatctaacatctgaattttccttatctcatttgtgtgtgtcctttaagattcaatgacaatgcacagtaatgtagataacgtgataatactttctgttgtgtttttagcacgctttgtataaatcatatcctcagggtcccctttattcatatattctacttgcaccacccaccccaagagtcctggtttattagatttttctcctttgccaaaatatttgggttttctctccccccccagcataggccttattttcataaatgtgtagtgatttcacctttcccgtaaagttggccagcctgcttgattatggaaattagatttactggtttctacttcccagggtcccttctagaaccccgcttatgaataggaattacattgacaagcaccagtctcgggcacagtggctgtttgtaaagacagcctacacatgttggccaaaacagtttcacccttgagttacttcaaaactggctggtggataccatctggtcccagtgatttatctactcctggtttgttgattagatgcagggcatcatgtttaccactatttgatctagtacctctgacctgccgagttcagtgttctggtttggaaatgcgcatctccttacaagacaaagaattcattcagtctctccaccatctccattttagccctgtgactgtgattaagtggttcctctaactggcttcctccctttgatagagcaaaagagcctcttactatagcctttgcaatctcttgcaagttgctcctgcctagattttattttgtgtttaacctgctgtgccttacaggattttctctattccttctctggactatttttttttctttaatcaccactgctttttcttctgccttttaaccacaaggaaggttctcttctctctccagtccccaccacctcccccgccaatataagtaattattctggggcgactataagtaagtttttttctttcccctttttaaaccagtctccaggcatcttgagggttgtttactttccgaactccctcagtaatgccctgcttttgtcacagattcttactctaatatagcaaaaactatgtaatggggtttgtacttttcctctcccatcaagttgttaaatttaatattgctgtgtggtcaccagtacacatttgtttatccacacttacttggtgtcctaagtcctatgtactactcaagaccaaggccaggtatctcttgggacctttcttcccttcccccctccatccctcatactcctgttctagaagcacttgttcaggaagtaatcatttttcgtgtctccagatcttggctgtagatcttggcaggtaagtattatgctgatgattttttttttcattcatgtctgtgaatcttcacacacaaatgtaagaggataatggagggaaatctatggtaccaatctaaagctgagtagaggaagacctatttgacagaaatatttaagacataaagagagtataagggaggtgatccggtgataaactgacagacgctctaaggtcgatatactgtcatcagcaacataaaaaaaatcagcacttaaatgcatcacaatggtacagagagctgtcatttccatctttgttctcccttcctttgatgtgatagggagccaactcccttcatctccgggtggaatttttgtttgtttgtttttatttgacatacatttatccttagacagtctaaatttccaaagcatctgcctttatttcatagagcggagagttctttcaacaaaatgattggctattaggaagaaattgatcatttgtcaggatagtgcagcagacacagtgcatattctgggcacacaatatttttgtaaagtcagatgcatatctactcaagcaaatagtgtcttgtcttaatcttttgaattttattcatgagttagatattctaggatgcaaatgaatcatatttatctgtagaaacctttggatattgttgctaagttgattccccaaaatattcagtcagactatgtgaaattgctgatatttgacctatttggcctaaaataatggcactctcataagaatcaacctttaatattttgtttttctttaatctctcaaagctcataacagaaccatttcaaaagctaaagaaaagattctgtagctcataatcctagagcagtattgcaggttgtagcctgaatttttatcaagggactgttttgtctttctgctaaataaagctaaatttccatttggtctgtaatttttagaaataaatatttccaaagactaaaaataatagtaatgataacaatagaaacaacaagaaaacaaacactcccccattggttaaacatagctgaactctgaaacatagaaagaatcccctttctgagaaatatatagcatcttctgatatcagtgttcataataatagctgctattgattgaggtatactgtataattttaatgcttctaacaactctctgaggtaggttctgctcttgtcctccttttacagaagatgaactagtctcagagaagttaggagggtggctcaaaattgcacagttggtaagcaacagaactgagcctaagctgggcatggtgacgtgggcctatcatcccagccaccatgaggtggctcgtgcttgaggtcaggagtttcagactagcccgagcaacacagtgagaccctgtctcttaaaaaacgaaaaaaataccagatgtgatggtgcatacctgtagtcctaactgttcaggaggctgaggtgggaggatcatttgaacacaggagtttgagggtacagtgagctatgatgatgccactgcactccagcgtgggtgacagagacgccatctctaaaaaaaaaaattttttttttttttttgagagagtcttcctctgtcacccaggctggagtgcagtggtgctatcttggttcactgcaccctccacctcccaggctcaggcaattcttctgcctcagcctcccgagtagctggaactacaggcatgcaccactgtgcctggctagtttttgtacttttagtagagacagggttttgccatgttgcccagactggtctcgaactcctggcctcaagtaatccacctgcctcggcctcccaaagtgctgggattacaggcatgacccactgcacctggccctaaaaattatttttttaattaagaaagaacttagcctgaacttgggcttatttacctttgaagctgttatgctttccatataacatgatgcctccctacctcagagactcagaacagagagtccagtcaaaacatttatagctaatttcccacactgttctgacatacatactatacagtatgtagttagatagtaaatcatgctccagacaagcttttctgttctcttgagtttcccacttgttgtgatttatccatttgttttttactgaactgttctgattgaggatccttggtgatgtggagtgtcttagtccatttgtgttgctatgaaggaatacctgaggctgggtaatttataaagaaaagagatttatttggctcatggttctgcaggctgtacaagaagcatattgtcagtatctgcttctggtgagggcctcaggaagcgttcactcatggtggaaggggaaggggagcaggcatcacatggtgagagaggaggtgccaagctctttgccaacagttctctcttaggaactaagtaagaattcactgccaggtgtggtggctcacacctgtaattccagcactttgggaggctgaggtgagtagatcacctgaggtcaggagtttgaaaccagcctggccaacatggtgaaaccctgtctctactaaaaatacaaaaattagtcgggtgtagtggcaggtgtctgtaatcccagctacttgggaggctggggcaggagaatcacttgaacccaggaggtggaggttgcagtgagctgagattgcgccactgcactccagtctgggcgacagagcaagacttcatctctaataaaaaaagaattcgctgctgcgagatccaggccattcactaagtatctgccctccacaatccaaacatctcctgccaggccccacctccaacactggggattagatttcaacatgaaacttgaaggggccatacaaaccatatctatgccatcgcacagaataacctaaaattcttggttcttgaagtgcctgactgttacgccatttttgcatcactataaagacatactggaggctgggtaagttataaagaaaagaggtttaattggctcatggttctgcagtttgtacaagcatggctccagcatctgcttctgatgaggcctcagggagctttcaatcatggtggaagggaaagtaggagacagcatgtcacatggtgatagcgggattaagagagaaagagtggggaggtgccatactctcttaaccaaccaggtctcatgggaactcagagcaagaactcacttttctcccgggggatggtgctaagccattcatgagggatccacccacacaacccagtcacctcccactaggacccatctccaacactgggagtcacttttcaacatgcaatttggatggtgcacacatccaaaacattttcattgacccttcttgttctaagttgctgcttactgctacttactggtggaataaaaagaagtttgggttctgtatgcggtcccaaggctaccaagtgtgtcagtgctgttagaagagttttaaaccaataagcaaaatgcatcatgactatttcttaatataggctcattttgtaatagtgtgttatgtttgtagccacaaatcatggagctatgaaggttcatctcataataacgaaacaatgcttttttataagagtatattttctacttgcccataccaccaagtcattcggccaaatggaagctcagacttggtgctactgagcaccttttcctatgtatatttatgaaactcgagattgaactattgttctttttcaagctcatgcagttctagtatagtcattctgcatgactgaacttaactctagtcaagtaaatttgggttaggttagttggtctttgtactggcctatgttaattgtcatatataaaaaatattaatagaaacactcatgggcaaaaacataagcatgctttctggatagcctggtagaactcattcttatttaggcagttcatttggaaaaatcaggtcttataatgctggacatttaatttggcttcagcctttgaaaggccgttcttccccacattgaaactgatttcagaatatgatttaatgtatgtgctgctgtagcattgcatacaatttaggattatgctgtcttgactcagagttaaaacataagagtagctagattaaaaaaataaaacatggccgggcgcggtggctcacgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaataaataaataaataaataaataaataaaacatgaccttgcatggtttatgatccagtgaaagataaagagaacaaagtgggctgttctctgttctttcatacttctggtactgatactttttaaagtacactacagtgtttactatttcaaaccgataagcacagcactgctgccaagtattatctttaaaacaagaccgacatttaattcagttgtcatatttgttctcatccttgaaggcagtttaaaaaacagttgcctctcattggttactgtgggatcaggaaaaactaggagcttatgtaaatatgcgtgtatctgaaaggagaaggtttatttttttattttcctttgaagtacctttaagtgtactcttaaagtatatcccgaactgcataccattatgtgttttccacataggatgaaacatcctcaaggagaggggctaaaaataagtatattaaagtaacttactctttgctggcagaaggtcctggtacaaaattaggtccttgaattttccaaatgaggttgtatttattgcccttcttttctaagaaaggctattttaataatttttgctatcacatcaaagacttttcatgataattatagtcaataattgcagtagtaatgctgcgtgccatctgcaggctctgtgtaatggaaactagggagaaaaacgtgtccctgtgcttgatgggagttaccacagaacgaaagaccctggtgcctgatcaccacttgcatcagttgtaggtgactctcccactcctgggcccttggtcatatatactgtcttttttttctccctttctcctttgacccatttccttccatttctttttctctcactccttcaggcctctaatgtgcaggagtaagagagaaagaacttccccatcccccatgtttgttgctcatcctaaagtagctgacaggccacattctaggagtagaggagtaattggaacttctttgggatcaagtgtttgaccaaatcaattggtttatgagtgagcagttggcccattaccaaaaagagttagagagggcaagctagacattgaagtaacggaatgagcacccactcacccagttgcaccaggtcagagaaagctgtctgatactttcaatttgtgagcatccggtctcaagcttgtctgtgggccagatttctgaagtgctgatgtttctcttaggtcctgtgacaggcattacattgtatagtaactccaatatcagccccatggaagcaaccctaagttcttacaggctcaaattagagtggctcctatcctttcattcatacccaaagcaaaaatggtaagatgcagccgtttcattcttggttagttctgcagtaaagaagtccaggacacttgcagcgcactttctggagcatttgtatctatctctttggcccagtggtgcctaagagggccctggtatggttagggttatctgaagatgactaggaattgaacaggccttacttgaatgtgtagtaaatgactggtttctctcttttctgtgtcacttgctgacaaagaggcaataacttttccatcttcttctctaaggaagtaaatttttttatgtcataagtagacacattaatactttaatatagcacctaagatctggctttatttttccttccctgtggtacttaagaaaccagaggaaaatggcgggtggctggatggcagcccagttgaagaattggctaatcaataccttgcctttgagttcaggcacctttttatcagggttttttagagcctagaaaaaaacagggattattcctagtgtgtggagaggcactgggtggtatctcaaattgttcgttgttgagtatatatcagtcacttgagggcatagaagctctcctctggtgagacctctactacaaaaattgaacggagctatgccaataatttattgactatccaaatataagtttagggaagcttgttatcaagtgaccaggttagggcctttaaaaatcaaagcactaacattgtctgagttttttttttttttcttaaaaggagatttgaatgtttagtgacttctgatttgtcaaaccaaggaaatgaaacagcatgtgtgtgggaagtctttgttctgccgattttgctttgttgaccaagaaaggcagcagaactaggtccccaaggagttttattcacccttgccttgtcagattttgctctgagtccgagataatgccttcagtagttttggttgtctcaaaaatggacatagtatatatggcaatgtataggttatatctgagtgtgtgactctctcctactttgtccaaaggcacctcctatggcacatctgttgaagttccaaagtgagaagaaacatgggttgagttgatttgcctgatttagcatcatctctcctgtcttttggacttgagttgttccaagataagattagaggacctcagagatcttgtggtggggagggggttggaggaattcacattatagagtaagaaggagagagaaaaagcctagagaacaacaataaaatccatgtctgttcatcttgtaattttcaagagggcggagaccaagccatttgtattttctgcactgatggatggcatctggcacataagagtcacttgataaatactgcattaagcaccaacaatgtttttgtgttgccaaatcgggtcaaaggttagtttgggagaagtgaatcaaatctttgacttagacttggggaaaatgttagggcagagttccattcccagataatctcttgcagtggtctagttgaagtaactagttcacgaagtggtaaatatagtggattttctaatcataatgaataaatcaaatgtagttaattaacaggtctgattctaaaggaaaggttctgaaaggtgagattggagaatcaaatggtgttaagaagccactaggataagtcccagtcagacctggggtgcctcactaataaaggcaagctggtagagtctataataaaggctgaggacattgaaaacttaagcaaactcagtcttccaggaaaggcaacttcgttaaataaggggaatctgtgctttgctagtgaccttgtgtttctcaggtggctaatgcatatgtagagaatggaaaaccattgcacgtgatctatttaggttttcaaaaagctttcttggtggcggggggcagttgatgggggggttcacaccaagccaaggaaactcaaagtaactggcacaccatggaattgtgggactgtttcgtcaaatattatgattgactttgaggcaggaaacaaagggtaagggataaacacaggtaattctctgaatagcaacatagtggctttcactccaaaattaggactgagacaagttttacttaaagctccaggaactgacctggaagaggaagtacacattgaaatctttacatttgtcaacaaaacttttctaaataacaaagagcctattaaatggtaataaattgtagggcatgtggcccaggtgctagggctttagataatgggtgaggaggagtttttgtttttgttttgcttttactgaaaatggcatgcttcatattgcataacatgctgcttgaagacttcatggccagttgccagggttggggaaactcagccttgcaaaacgatggggagtatgaggagggctctgcctctccctcatctgcccattccaaggttcagaagaatttttctctcatgttataaaattaacccctggtcaactgtggctcatgtccatatccataggaactgggacttattaacagtccttcagtgcagatctgtatcagagtaagccgtaacttaactatgacttttagcaagaattttgtgaagtgggttttaaaggatgtaattaagcacagacattaaaaatgtaaatcttactttcctctgcaccattttattgatgcctagctagaattttgaggaatggtttgcatggatcactgttttttgttttttgttgttgttgtttgtttgttttgttttgtttgcagaatgaaacattcccccccaccccactccaaggcttgagtgcagtggcatgatcatggctcactacagcctcagcctcctgggctcaggcgattctcccacctcagcctgcctgactagctgggactacaggtgtgcgccaccatgcctggctaatttttaaattttttgtagagacacggtctcactatgttgcccacgctgatcttgaattcatgggctgaagcgatcctcccactttgacctcccaaagtgctaggattacaggcatgagccactgtgcccatcccagaatcatttttctttatgtgaggaagtggactttgccattggtgggtttacataaaggctttctagatagccatttggagaaatatcttttggagaattaatgatgaatgaatatgttattcttctggtatattttttctagacagtaaatttactgaaaacctcttaccacgctgtattttgaggggagaaattttgggtatattgtgaaaaggagggttaagagaagctaaagacagcttttaccttcccttttgtttaagctgaaagcaattactaaaaaagagaaaataatttgatgttaaaaattgtcatgactcagccgagtgcagtggctcatgcctgtaatctcagcactttgggaggctgagggggaggattgcatgagccaggagttcgagaccagcctgggcaatgtagtgaaaccccatctctacaaaaaatacaaaaattaaccgggtgtggtatcacatccctgtagtcccagctactcgagaggctgaggtgggaagatcacttgagcccaggaggtcgagactgcagtgagctatgttcacgccactgcgctccatcctgggtgacaaagcgagaccctgtgtctcaacaacaacaacaaattgttatgactcacacaatccatgaaatgtacgtaagaaggcagactttaatcattcaattagagcaggtgtctgaaatgtctgatatctgtgagcctccccactcaccaactgtattttcttctacacttgcagcaaattcagctgttaaccatttcggatattcctgtgaattctaaatggctgtggcaggctatctgagaatgagattcccaggatcttctttagagattatttggaaataatatggaaaatcatctgctgttggaagtcagtgttgattcagcccctaggggaggaggaaaggggtgtgtctgatgtcttcctgaggataccttcttccttttgctttctccgaggtcttctgtgatggtgtgcaggagactgcccactggggcagtcactggagatgcaaagaaagggcaaagtgctggcggctagccctcccctactctgagaatcaccatgaccttccaagccaggtctgatcagctgtctcagagatggccctgctaaggccttggtctaccagctattatgatgtgtggcttggggatacaggttccagagggaaaaaaagtcctcaccaatggcgttttctgtctaggctgctttttattcatagctgaatgtatcactggggctctaacagacgtgatcaaccctgggaatctcagtctccatacagtctctcatctcactctctgtaaaaagaaaacctcagagttaggggagtgggagtatgagaaaaattcaccaataaaacaagaaggactttgaggagagttgtggaaatcttaatttcataggcactatgtaacaaacaccttcaaagtctgtgtatttgtttttctcttaaagagcttgaaactcacatgtgactccttcatatcacttgaatgagtatgaaatccgtagaggcatttggaatcatttatttatccctaggccttctgttaaattatgagcctagtgaaaatcataattgctacttaagagaaattctcaaacgatgctaccaagatatgtgcacctgaattattgacagaaaagatctcctttgttagttgcaaaacaagtaagagagctccatcttttcctgtctgctccttgctatcccgcaaggtcccccagcacacttctgtgagccttttattagcactgcttagaaagtatttacaggagcctcagaatttttggagagttttgggttaatcactagtagtattactattccttttgagtcctggaggtagtggttgtaaatgtgcaaaatagatgcagttgcttcagctgctcagaagtgatggcaacacaaggtcaaagtgtgcatttcaggccattcactcagtttggtttggtgtgccttaataaacctttggtatagttaaaatggggatctaagattgtcagatattaaccttggttgacaatttgcttatcatttgaaaagcagtaagaagccttggttgatttctgtctggagtgcagtttaaagctattataagctcattgaaatgaagtgtagagttttaaagtagcaaccctaactcttccaactacacttacataaagttattcttagaaaaatataataaaactgattattgaatgtatgtgtttctgactggccttctctatactaccttgcaggattagtggacctagaaataattggcagtcttaagccctccagagctatattttggcaaggttttgcaaaatgctaactggctgcatttctcctactgattagtaggtgatctcaaatcatacatctgcataatgactgtaatttacgtgctttgttattaaggtcagatgactccaggctttggatgcacatagcacattttatgcagtaatttcactcctttttggaaggagggaggatggattaatgtacacgtccccccacctccctggagttattaaaaacctttagagattttctttctttgttcccatgaagcagagcattgtatgttcctcatggggtcttaggtagcttagaggggctggagttatatagcaacctgcattttagttcactttgtggctacatgaatttagatctaagaaatgaacagaaactattttggtaatgctttagaccaacagcaaggaattattttacgtttagaacaataaaaattagaaaaagagtaaagtagcaattgagggattaggaaaattgctccagcaaataatagcttaatacagctccccaatattagaattacatcaagtatttatatttttgaaagcatgatgaaagtttttccccgctggccacatgtatttatgctttttaatttgaaagccaagacttgcttttcttaaaaaaaaaaaaaaaaaaaaaaaaaaaaaaaacttctaatagaagagttttagatttacagaagttgggaagatagcacatagactttcctatatctcacccccagtatcccgttattaacatcttacattagggtgggtatatttctcatgattgatgaaccaatattgatgcataattacgaactaaagcctacacttaattctgatttcctgagttttttggtaactgtcttattgggatatagttaatataacaaataattcacctatttgaagtgtacagtgacttttagtatatctacaaggttgtacctccatcaccaaaatcaatttttcatcacccccgaaagaaaccccgtaccttttagctggcatcctcactttcattctttcccctctcccccagccctgggcaaccaagaatctacattctatctctagatttgcttatgctggacattttatataaatgtggatttttttcacttagcagtgtttttgagattcatccatgttgtaacatgtatccgaatttccttccttccaatggctgagtaatattctatttacagatacagtagaccacattttgtttatccattcatttgctgatggaaatttggctattatgaataatgctgctatgaacatttgcatacacctttttgtttgatttccttagtttttttccccacaatgtacttattctgttccaggatcccatccaggatatcacattatatttcctcatcatgtctccttaagctcctgtggcttcgcttttgatggccctttgaatcccttggttgatggcttggtcaccatcagttcaccatcacatatgcatgccgttcagctccttgatgtgccctatttccacatctttctgaactagctagaaaagaaaagtttgttaaaagaaaaactttggacatgaggcaggagaatagggtctggaggcagggaacctgaggctgattcatgctgacttcctataactaaattgaaaggaaaaccccaactttccacgcttaagtgacaaaaggaccagaggctacttcctttgcaacaccatgccccgccccgccttccccctttttctgcatggcaggaggaaaattgaaagtacctctgattggttgctttcccaatcagacatttgcataggagtgtaactttgtaacttcattttagcctctgattgcaggccactacttcatttgcatggggtaaacaccaagtggccaatagaaacctctagggggtatttggaccccagaagattctgtaactggggcccatgagccactgcttggttggctcccaccctgtggagtgtactttaattttctgtaaatctctgcttttgttgtttcattctttccttgctttgctgtgcattttgtccaattatttgttcaaaacaccaagaacctggacaacttgcagtcaagaccctctactggtaacagacaaattaattttaacagaatttaactgagcaaagaatgatttgcaaattgatcacccctccccacaaccagaatatgttcagagggattccagtactgccatgtagttggagaggatttatggacagaaaaggaaaagtgatgtacaggaaacggaagtgaggtacagaaacagctgagttggttacagctcagtgatttccttatttgaacatggtttgaaccgttggccacctgtgattggtgcaagagcaagttacagtctgtttacacacccagtttaggttacagttcactgtgtacggggaaacctttaaaccaaactttaaatgtgtaaggaggcagctttaggctgaacttaacaaggtgctgcttttctggcgcccctccctcacctagtacaagttgtcagaaatggttcttaacacgaaacttcagtagcttatcagagcataagagatgttcatttctttctttgttttgcaattgtactgtcttacatttacataatgcctccttgttttcaaagggcttttttcgttttaaggttccagtggataactgactttcccaagagtctttaccaaaagcttcccaatcatgtagagctgggcttcaaacccatattcctgacttctagataaaacttaattatccctagactgctgctgttatctctgcagaataaaagaaccaagtagttttaaatatttggaaccttttaaattcactccttaaaaaaaccccttgtaaagagctaagttttcttcataactcaagtgaggcactcttctagaaaggccaatgcaaaatcatagtctcttatgtttgcagttttcatagtgctttccagtctgttcttctcaaatgttcctcactgcggtccttacccttaaggaacagtttgtctctcttatttaccataggcatttggttgctttattggtaaaattagtccgagtaccaagagtgtctgccttaaaaatcccactggtgcaggcaaagcctgggttctctaccagtgtcttgcaatgttttctggctctgttttctccatttaggacactgggggagtaaacactagagattttctttatttcccgcaggtacagaaagaaagctgacccctaagtggtaactaccggtattcctctattactgccccacctcccaaaaaagtggggagaattggagagacactttcttggcatctagttggatttctaaatgtattttctgagagagatatagaaaatggttgttagacatagttgaaaatagtcaccgggcgtggtggctcacacctgtaatcccagcactttgggaggctgaggcgggcagattacctgaggttgggagtttgaggccagcctgaccaacagggagaaaccccgtctctactaaaaataaaaaattagccgggtgtggtggcgcatgcctgtaatcctagctactcaagaggctgaggcaggagaattgcttgaacccgggaggcagaggttgcggtgagctgagatcacgccattgcactccagcctgggcaacaggagcgaaactccatcaaaaaaaaaaaaaaaaaaaaaaaaaaaaaaaaaaaaaaaaaaaaaaaaaaaaaccagaaagaaagaaagaaaataaagaaagaaagaaagagaaaatagtcaagttagtagtaaataagctgagggctggcctgagcacctatctaccatttataacattttctatgggaagctgagttatgagcaactgaaaataaacgaacattagccgcaccccatttgtacatcagaggcagcctttggtgagaggagtaaatgagataaaatgagaaagcacagtttcacagattgcctcagagcgctgttaaatgatggaatagattcctcatattcaatgcctacttctttaaccattgatttgaagtgcctcaaaaaaaaagaaccaatacacactcagcaggattgagagtaatttattgtgattgtctttgttcagctttgaaaactaaggcattgatattaagactaaagagaaattacatagagctggtgtgattgaaaaaagtttggctctttcgagtgattttttttgttttgtttttaatgccagagagttaagctttaaaagcacgcttcattgaatcccatccaagcctcctaggacagggctgggggaccttttttctattgagggccactgacccacaaagaaaaaaactaatcaagggccatgtacaaaaagcaacttaatttaggtgcttccttggaaaaccataaagcattgaattcacctgctttttaaattaagaacaaggaattctcaacaagtacaacaaataaaaaaacccttcagtttcatattatgcaccacttaagaggtggggtgggataagagagaactacatggttagagtgaaaagagagtggaaagcagacaggagagtcttaatggactagaagcgatacatgaagaagaaactgtatgtcaagagccatggaagcaggagattgaattagggaaataggggagagaaatggcagttgtagatcataatctactattcactaaggtagtagactaactggttaactgctatactcagctgttccacagctggaattcagaagcctttctgacaacaattcttaaggaagggtcagaatcacctagagcccttgttaaaaagtgcaagtgtccaatgctacccccacagtggctgtctacctgtcccatctttattctgttgtcctcgtgttcagctctctcagcctaaaggaaaaattgtggcatctttcttcagtgagaagaatataagatcaccgggcttagaaaggaaatctccagaaagaaaagatttctcactcaggcacagcattttagaagcagtctcaaacacataagacagaatgcctttcaaataatatgcacgccctagccttcaaaataaaccattttgggtgcttaaagtagaaatattcaagttaaaaaaaaaaacttaattagttgctcaagtcttcaaagattttttaccagaacatggagctataatttcattttcaaatgtacccagacttgtcctccttttcctccctgtgcttctcattagcactaactagttgtggcaccgaatccccagtagcccaagaatgtcttggggtttaattcacaagtgtgtcttggactacgtgtgtcacagggcttttggcaagaatgtcaaattacattttcaagtaacgctttttagaaatgcagacaggataagtggtgcattcggggctatatggcccaaagtgtgaactttgcactgaggggcagacgactttgccagcagaaacattagccaagtatctaccctgttgttgtcctttacataaggcaagcctttcaccattagacaaaatcttcccggaaagatctctctgagatgaaagtgcactatttttttctttttaaaattagatattgcaggccgggcatggtggctcgcgcctgtaatcccagcactttgggaggccgaggcgggtggatcacctgaggtcaggagttcgagaccagcctagccaacatggtgaaaccctgtctttactaaaagtacaaaaattagccaggcatggtggtgcacgcctgtaatcccagttacttgggaggctgaggcacgagaatcccttgaacccaggaggcggaggttgcattgagccgagatcacgacactgcactccagcctgggcagtagagtgagactctgtctcaaaaaaaaaaaaaaaaaaaaaatagtgccaaaacaaagacgtgccccagtgttccagtatcagcaagtctcgataaggttctgcttgagggtcactggtggagatgagatgggtggagtgcatgggccactctgggccttttatgtgtggcagtgtaaatggtgccatccactcggaccaggttactaggaaaacttttattgctgctacccgtttttgaagggtgtatccttagtataaattccctgtgggtgagtttaaacctgtcaacatctagcaccttcttcaacagagaaaattattatttcctgctgtctcttagtattttcttgctttgaggtgtatgtgtgtgtgtacgcatgtgtttgtgcatgtacccatgtacactgggggcagggaaaaatgatgggtacttttctgtgaacttagaaacctattttgataggatccagtaagtgaccctttattaggtgtgaaccctgttaacattaggtgagtatagtttattttccaaactgacaagttattttgccttgaaaattcatgcataccacaatggaatctttgcaggtgcttgaaaaaacagcctatcctatgatgaattttagcttatagcaatctttaaaaattttatttaaagtctttattatgaagtaattcatttaaatcaccctatgtgggttctcattctgagcattccaattcattttctacagggggtatgaatataatatgtattatttaatatagtgacagcactgtactatttgggggccttcatattgttttatgtgtttagattgtaatggagggaacccttacctcaacactgaaaccaggagacaactgaatctttctgtgttaattatgtgtcccagtaccgaaggcctgctgtgaacttgttaagccagtgaagagggagttttgtttttggttgtaacaaaggtgtttccataaaaccgagccttagcaacccctcttctgtcactaatgagatctaagatattctgcagactcacagctctaaacttgattacacaaccttttttttcccttttttttctgttagtagaattatttattgaccaaggttttcagaaatgccaaaataaacttttagcagtttctggatgaggaagttatttgaagattgttgctctttctgccttccttacatggtcctttaatgctgcatactccccttttttgggggcactaacattctccctactttttaactgccaggaaggaagaatgatcgggaacatatatgattatataattatttgcatatgtgcagttgacaatctagtgttagtcaaataaattgccagctcaattttatctgaaataccctgctaccctaaagctgctttgatatctccattaggtgaagccctatttcctgtaagtacacatggccaagaagcagcaatggccagctcatggaccatttcgttttccatgattagtgttgtttgaatgattagcttttaattccccatccctttgttgattggtcacacttaccattgacaggttcacatgtcttcagtatactcattcctgagttcctcagatcatctctcttttcagaccccttttgacttgcatagaacatggacagcaatagcagaaggaacagtgagagtcaatccttgtaaacgtgtacaaaattataccacaccaattaatattggagagactgaagtgatagtagctagtggggtttatttttgagtggcattgcatcttgtggtcattataagagaagagacatcgtctcttcaaagcacaattttgttctgtgacagaggagaacaagggggggaactctggggcatatagaaaaaaccccccgcccaaccctcacctccaaactgcaagccaaatgcagttggtataagggagggagatacttcgtgggttgggttgctgtggagtgatgtgtctttgacatttcccttgactcttggggctgcatcactacataaaggtgtttattggaagttgttggtctatactgagatgatgctacatacacagaatcatagggtagatatagtctctgacatctgcacagaatacattggataaaaaaaatcttaaactcaaggattgaggattaccatcacccctttgtgatttatcataggctcagattatccagcataaacccctatagtttcctctttgctggcaacccttgaaatgcacaaatccctttgtttccccacagtgtaactattgcacatgtatttgctcagtttttggctgttgtcacatattttataaaccattcgtcattaaggacagtctctcttggagtgtaaactcccaaatctggaaaaactgtgtctcgtttgcatgacttctgcagtatttagcatagaatatgagaatctctgggaatttataaaagagactttagttgacatggaatattatattgtttattgactacaccagttttcctgttggtttagccatctctctgattggaaagttcttttgctttttggagagggctttattattttattttctcaaaaagggaatgaatatttttagacttcctggaacttgttagatacacatgttgcctgggcctttgcaggagcctcacaggttgaaatgaacctaaatcaaacctttccctcttggacttcatgaatgatgatagacattgactgtcttactttttatcttgcaggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatggtatgttattcaagtcatatgtaagaaccggcagttaggtctgtactgtagctttttcacagctcctctgctccctcagtgcttaagttttctcccaagatgttgtccttgttggataccagagacgagtttaccctgtagctttatggctagaatacttccggatgcactggaatctgtatggtaggcattatggaaatatggtcacaaggagacaaaaaatagattagtttaacttaaatgctttgatttattttcttgggtgaacacagaatagtgttgttgacgcaagtccctttaaaaaaaaaaagacctcataataaaaagcaggcatctgaaaactgtcttagtcaaaataaagagaatttacagatgctggacttcaaattaaatttcaaaatggatccccaaagacaactagaattcctaaaagttttgcagaacacaggcaggattaaagttcttgagtttccatgcagcagagacccaaaagtagccattttactatagtcttcattaagctgggctccatccaacctcacattagctgaagctctggcatagtctttccatgtaaaagccacgacagaacccattctaatcacctatgccagacgtggcttcttgcaggcacactttctcttaatattgaagaaatagccaatatgagccaattgaaagtgtactttgatcctatctgaacaatggtacagataacagactttaaaaaatagaatatggagtccaaaacacctcaggattcttttccctggtgctgttcactcagtttgaagatttttatgaagtagatttagttttaagaggattgatttcctttgtgcctgttttaaaggccattctaattacatagtacctttgaagcatgcttttcttgacattatgtgtggtgaagaagtacaagacaaattttctagatatgaaatgtctttgagtatttctgcaaagggcttgttaccatggtgagaaagttagactaaattagatttgatatagctgataaggcagtcctcagttaaagaacaggttgtatttcaaatgttggctttgagatgtgttatttcaaacttataaccaatttaataagtgttaggttcccaggtgagaccacaaaagcatatttaatctataatgtagttgaactaaaacactgtctatgtagtatgccgttgatcctacccattttttcaaacacgctatgtgcaaaattatgtcttagttctatcacctttccctggatgaatgggaacaatttatatatctgtatatccttcttattacccatatccccctacatatatgctgtagctgttaaaagtatttaacaatatgttaataccatgtgaaaatgggtgttattggcaaaatctatcattagacctcctctgtctctcctgatcactgaattattattattgaaaagaatggtgttttcctgaccatggcatttctcattcaagataataacctaagccttttcttttactttggggagaaaacttagaaagctaattaaatggtcatttttgaaaacttaagatgttgatatttaaaaatcaccacttaggggcttcataatggaatttagaaggaaaaaaaaatctgctctttagaaatgactctcccgttggcagcacaatgtagtggagataaagttgtttccaagttccaaggccttctactgcaagtcacctcatttcttgttagacttgtatcttcctggcagggagcccacagtcattgcctatgggcctactggtttagctattcttttcccttctcgctccccatggttttatagcactactatgattccaatgtgtagtgttttgttgttgttgttgttttcttcttaaaccatacagagaaactttatcagtaagtgttaacatgtgttttttaaaaaggatagaaagtttttcttgctcttccctaccaggcttcacattcaataaatatgttaacactgtgccttgatcagtttcaaaactttaatgattatgaaactccagtgttttttctgacttcaaattaaaatatggcataggctgggcatggtggttcatgcctgtaatcccagcactttgggaggccacggcgggcagattgcttgagcccaggagttcgagaccagcctgagcaatgtggtgaaaccctgtctctactaaaaatatgaaaattagccaggagtggtggtgtgcgcctatggtcccagctacttgagaggttgaggtgagaggatcacttgagcctgggagttcaaggctgcagtgagccaagattgcgccactgcactccagcctaggcaacagaacaagaccctgtctcaaaacaaataaataaaataatataatataacataaaatatggcatagacaataaagttagggaacatagatacaaggtttttttttaatgggtagtagctgaaatgtacttgatctggagatcaatatactggaatgctggaatactggaatgccagaatactttgcacattttctccatgttaggttacagaaacaatgagataattttatatggtaaaaccttagttgactggtacccaccaaatcatagtcccctagtgggtgctgcattgattgattaattttttgtttgtttgttttgagatggagccttgctctgttgtccaggctggagtgcagtggcgcaatctcggctcactgcaacctctgcctcctgggttcaagcgattctcctgtctcagcctcccaagtagctgggattacaggaacacaccaccacgcccagctaatttttgtatttttagtagagacggggtttcaccatgttggccaggctagtctcgaactcctgacctcaggtgatccgcccacctcagcctcccaaagtgctgggattacaggcatgagccaccgcgcctggcgatgattgactaatttttaaggctgtcaattaggacttgccagtaattctcaatgcctgccgatccaagggcattgattaacaggctataggatatgtcttgactctcagaaattcaagggtggatgctttggccaaagaattatccaaactattataatagctaaaccctggctcttggtgtgaattgaagagagaaagttgggcagactaaaaagatggtggtagggaaccaagatggagcagtgaagttgcacagagacagctggggacatatagtaaggaaatagtaaaaggacacatggaaatattatgggtcaggcaacttcaagggagtaccttttgtcatctgcaagcttacagtgtaaattcaaagtggtgaccttgaccccagacaactttgtctatcatcaaaacctgtctatgtctatgagataccacttctttctaaggtagaaataattacttttaaagtaattattgaaaaaaaaccttttcaacaaaaataaagtttgggggcttgtagagagttagccttctgttaccagaaatcatctcattatcccagttttccatcattcttcctcaattgaccctggtcagggttctagtgccagttctgacatttttatagtcattggatttgagagatgagtcccttctccagttcccttacctctaaggcccttttttattctgtacttttaatttcctatcgtttgcacatctcaagagactgtacggtctatatcagtttttaagatataaactcgtgtgtgtgcgtgtgtgtgtgtgtatgtgtgtgtgtgttcggatttgggtgacgtacaagagaacacttcctccccctcaaaaatcatcagatttcttatattttaaatctatatcactgagtttaaagactggcctctgtgtttttctatgctatcattttttaaacccactttttaacttaggatgtttaataccagaaatctgtattctgctggagacatagagccagattgtggtagtgacagagctagctgctccccctcttggccaattctgggaattttttgatagtagagctgctaattaacttagctgaatcagtcatctcatgaatatgctaatcacatacttaattcaggagggagttagggaaaattgcttggcaaagggaatagaaatagaagtggggcataatccgtgttttgggaccacagcataaagacccgcccccaaatgcctggcattttgtgagaaaatagttgtttttaaaagaagcatagttaaaatcccaaataggttaaggtgattacagctgccatgttaaatgtatttctgaattacatagtaaaaatgatgttacagctatgaagtaatgtcattgctacataactgcctgtatcaaactgtagatattctgcatgtttaaataactaaggaaatggttgttgtctgatgctagtctattgggaaaactcctttaatttgtcattttcagagcaaatttaataactttggatgggaggcagtgcacagtgaattatcatcctagttctgcagtgaacccactgtgactgtgacctggggcaattaaatgagtctcagttttcccatccataaaatgagggggttgagctagatgctctctaaaacccttttcaatcctaccaattctgtgaatcttttaaacatgtgactagaccagctgctttagtgaaaggccttacaagatgttaattagccgtctgtatggtaccctctattttccctctatcattttttaactctcagctactttcaccaggtctttgaaaaaccctcccatgagcctgaagcttgttaacttgaataatagtagaaattttctgaattagcttaaaatgcacacaaaagaaataattgtctgtcccatctatctgcatgggccaagtgtaaaccaagcagttacccttcccttaagccctaaggccccttgtttcctatcacttcacagaggcagggcacgaagcactcttcagacttagcagaatctgcattttaatcaccaactgcaaattttctgtagttcatattagccattaaccagtgcagaggatcagtgagtaggaggcattaaaatttatatgcccgtgaaaggcatgacctcagtggaagcgagctatctgctaaccttaaaagacaaatatgtccagataagcttcatggccattgactaagctgaaatttctggaattttcctgacccctgactttaactattttctacctatatagataattgtcgtttatatagccacacttactaaagatcccctgagagggttttacattggaaaaagtctaaaacaccctcaaagtaagtgtgtcatagatatgcatagcataatatacaacattgattggtttttaatcctcacctcacatttcattaagacattaaaaaaatcattgctttctaaaacctctgctgtagtacagcgggcaacatttcataggctgagtagcctcgaaagtacggagaaagacatgaggccttctggccttcctgcaaatgcagtgtttcttccagattatgccagtggtctccgatttagtttgaaagcactgctactctttcctttatgattctattttcttttctttccatatgaaagagactaaaaagccagctacttttgctaattcttttataatctctctgtgaaacttgaccagaatgagccactgccagcttactgtaatcaaatcaaaagctcagacaaaatgcacacatttctctattgacaaaggttttctgccttttgagttgttatctgaagtgtgaccaattgtgactttagcattggctatctcatcggattgaaaatgcatgtgcagctttacgagcccaaagcactttaactttgggcctctcctcttagctttgacttcttcagaaggcatgacatcagcaagaagcaatggatctgtctggagggaagtaaatacatagaagagcttcagatgaactgcttttatcaactctgttggttcattgctctttgggcctgggagtttggaatgttgttcatcactgcctgctctacttctatgtgtctgtctgtccaggcaaagaacagggcttagttgatctagcactgactccaaccgattgattgagagaattccctgtgcaggcaggcttcagccctttcttgttcattgtccacacccatcttcatcaccctctctcgaaagaattagcagagcaatggaaactcttgtaataaatatgactctaacagcaaggatggtacatggacacaccctttctgcagatagatttggcagtgtgtcagcagttttgaatatgttcatactcattgatttagtaattccacttctggatgtgcatcccaaggaaagaaagatctgcataaacacttatgtacgatgttaataggatgttcatcacagcattatttctagtggtaggaaattggaaataagcttgcatgccccacaatgattacactattctccgtccatgtggtgtcattgtatgcagccattaaaaatgatggttctgctgggtgcagtggctcacgcctgtcatcctagcagtttgggaggccaaaatgggtggatcacttgaggtcaggagtttgagacgagcctggccaacatggtgaaacaccatctctactaaaatacaaaaattagccagatgtggtggtgcacgcctgtaatcccagctactcgggaggctgaggcaggagactcacttgaaccagagaggtggagattgcagtgatttgagattgcaccactgcactccagcctgggtgacagagcaagactctgtctcgaaaaaaaaaatgatgcttctgaagaagttttaatcacatagaaaatgctaaccatatagtgttacataagaacacggtgtaaatacattttatttcaaccacgtagcaacatgtatttcataggaaaaagggaggaaggaaatttgataagccattgttactgtcttttagcagtggggattatatttatattttcttcttacctgtccatatttttcaagttgctataatgaggaatactatttaggaaaaaattatatatttctttatgaaaaatatggaaactgctttggtgaagttttaaaataatgtttttctttttattaagtattacagtgctcactgtagaaaatttggaaaagtagaaaaatacatcaaatcctccagtggttaaatagaatgaagggaataaagggaaatagttacttttgaaagcatgaaggtatatcacttttctgattataaaatgtcactgaaatatctgggggaacaaaatcaagaaagatagaatgaaaaaaattacccttgatccccagcacccaaccgtcactcttgtatttacctaatctttttgtgtacgtagataatgcatatacatacatgcaaattggtatcataatgatttgctatttcatgttctgaattttttttttttttttagacagtctcactctgttggccaggctggagtgcagtggctcaatcttggctcacttcaaccacttcaagtgattctcatgcctcagcctcccaagtagctgtgattaaaggctcatgccaccacacctggctaatttttgtatttttagtagagacagagtttcaccatattggtcaggctggtctcgaactcctgacctcaggtgatctgcccaccttggcctctcaaagtgctgggatgacaggcgtgagccactgtgcctggcctgatttttctcttgacattagattattaacagatagactctattatgagatgtgtgtttgaagctatatggtacctctctgactgatccacatagaggttagtacatggaacacttgcaatggctcctccagctccctagcttacttatacgtgtctgaaaccttctctgggcatttccgaatgcacagaactctgggcatgctaaagccaattgcctagctggtactgagagtgcccttagtagaaatggaatgatgcccagcaaaagggaccttacaatactgagcctgtgtccctggccacattagccaaagatgggggccatcagtaaacattgtatttattcccttggagccttagcattcaaaatgtgttcacgaataaaagcaactttgggaagaaaggctgatcttattttggcagaatcccctagtactctgtgatatgctaatagctcctaataagagctacagctggtgattggcctgtccaccaaggagcagcctgttttttgtttgtttgtttgttcgtttgtttgttttgcttagacttagggtctcactctgttgcccaggctggagtgcagtggtgtaatcatagctcactgcagcctgaactcctgggcttaagcgattctcccatctcagcctccctagtagctaggactacaggcatgcagcaccatgcctggctaagtttttaaatttttgtagagatggggtctcacttttcagggtagtctaaaactcctagcttcaagcagtcctcccgccttgggctcctaaagttttgggattacaggtgtgagctgctgcacctggccaaggagcagcatattgatttgctatcaattgataaacataagttgagtatatgatcttttggtacactagccttagcaggtactctttagaagagtgagattatgccgtgctcgagaaaaaaatgcctgtttaaaaaaacaaacaaaaaaacatatgcagactttatcaaaaaagcaaaacaggaggagatagtgataaatcaaatttcaggttgtcagtaaaatgcttgatgcttttcctttttttccttacatttttatatgcttatgtttgctgttcttcattaattacttgatcttaggtgaaagagtcgatgggtgtaactctttaaattttcttagaagtttgaaaggtatgatttgtagcatttacaaggaggcttcttttttcagcacttctgttgatctagtaacttaatgtttgcatgccacaccaggggtatgaaatacagcatttatagtaagagaaaaatcaatccttatatgtaaaaggcagcttcctaataatgtaaataccaggtggtaatttatagcaccaaaaaaaatggatcaaatgaaaagggccccaatctcttaaggttatgggttaattctagaatgcattaatcaatagccagttgattgtttataaaggagtaactaatgtggcatttagtagcagaactggaggttctttggcctatttcaagaattttgaatgtttatttgatgcaagacaagtagctggggatagaagttccagaagtacatggtgttcttctcttttttaaaagacaggatatttacatagaaaacatttatatggaaaagttttgtcttttcactctagtttttcccatgttaaattagtactacttgcatttagaatgattagattttagaactggaaagtacttacacttccctagctcaatccttataccaagtggacttctggcaaagaaggtagtatgcaaatgaaatacatgggtggggggtgtcgacctgctgatttattcttattttttatatgtgtgtggtgtgtgtatggtattctcttgtttaatgtaatgtaagctctcttctcaagggtgaggtttccccattccctatttttcacccagcagtcactcccaccctcatagatgtctgggacgtttcacaacctttaaaggtagaaccattaagcatttcccttaggataaacagttcccaattttataaggccttgcgtcttcttagaagacctccagcagctttggcttcatttatgtcccctcagatggataatgtttgactccactaggaaagataaaaaccagtctttaaagattttttttaaaggattgtagatacaaagaaactctaagagtgacaacactatcatctcacatattagtaataatgtttatttgttgagcatctactttatgccaagcattatccatatgaggtgagtgataatagccccattttatggatgggataaaagaggctcagagagattaggccttttgcccaagcaaggtcatacagtccccaaatgagagatctcctgtttttcccactgtgtcctcctgctttagattcatagcatgttacagtgtttatttccatcctgtgttgagtggccattcatgagctcaaggagtagcagctgctttatctttagaatgtatatacttaagccttcaaactgaaaattgaaggggaaataaacgctgatcacagacactatatttcaaatccttgcaaaccaccacctctcaaactttctttcagacaccagtagctttacttaaaacagattccctgagcagcatttttacatgaatacaagcaattgctgcacagatctaacttccaatttgcttggcttttgatcgttgtggaatcctggtttacattgctcttggctggttctctcttagtcaccaagtgtattgtaattagtttcaggcataatgattatgagcaatgattgctaggtgtctagggcctgtacagctcttcttcagcagttaagatctgaccctgattctgagttctgagaatgattgaaaaaaaaatggagatgaacattgcagcgattactgaagttgctattgatggctgtggaccaggatctgaatggctaatttatgcttcattcctcattgtagaagtaaatgtcatgggaatagaaaggaggattggggatgtgaaagaattatgcaagaacatgcgagctgctagtttaataggaggaacagatgcaaaaggattttttctccttctttctaatagcaaattattatgctttggttgatattgtacccaattgctatggattttagaatttaaatgatgtctgccatccttatgaggtccctttgaggcaaaaggcataggtagaatagtcccaagcaacagggctagtaagaatccatctaaaaagaaatgagtctgggtcttctggatcccctgatttttgtctggttgactctcatagattaaatatatgaatatttaggaactttttgtatgtagtgagggattaacaattttatagatgtttaaaaaaatctctggtattctcataaaaccgtatgtggagagtggcagtgtatggtaaaggtgaattggatgggggaaatttgtcttaccagaaattttcattatggtctgattgtgcaagaagaaggttaagatgcatggcaaaacaccatgtgctttgatttgagcccataagagccactcagtacatacttgtcaaattgcatacccatttggagaaattatgacgttttaactcattattatcagttttatagaatttctcaagcatttattaaccatatgctcacccaaatggtcttcatatttgcaacttatatagccacattaaagagtcttttaaaatgtgaaggaaagaaaataaattttctgaatgatgaaatgaattaggatttagtatgtatatagcaccaacctaggctcttaaagtacacgctagcataaacacacacacacacacacacacacacacacacacacacacacacacacactttcctggacagaatgtgagtcatggaaaccaaagtatggtccatggtgggtgtcggacaggggcatgtcagtttcaaatcattctcctcttcattaggccatttctcttgtactccaaagtagctatgttatatatggctgcatccacccataagctcttgacctgaatgaggaactccaagattgataatattttactttttctgtaaagtgttcagtgatttagtgtttgtttgacttgcagcactttgtcaaaaggctaaactttgacatttattagaagttttaaattaaaactaagcttgaaatgtcacaccgcacctcgccccacccctaaaaaccaacatgactctaggtgacgttccttaaaaatgcaagtgagttttgagaattacttactaaatgagtctgaaagcacaactcaaataattctgaatgtccaatttctgctgatatgtgccaattttatgagcaatataataaaaattcaatataaggaaggacatgtggtagctgttggaatccactctttttggtcatgaaatattaatagcactggattgacacacaaggcttgcatattgttctcaatgatggcaaagctttgtttttccaatatgtgatagctatgtgtgcaacacactggtcatataataacgcaatccacgtgtgccttttatgccctccatgagcaatcaccacttggcaaggatgctagcaaaattcaagcatggtgtgggacatggaccagatgacatttaaggtcccttctcaactttgaactctagaaaagtactgcatacatttaatcatctatgttaacacttagttgagagagttccacacaagaaaatttgtccccaagacaataaaaaagtcattcctaggaatgcaataaatttatttaaaaacacaattcattggaaagacattttctcttaattaaaacattaatgcttgtcctgactgcttcatactcaacacagcccctgagttgttggtgattgcaactgataggtgaaatgggagaagtttcagcagctagagcagttgttttccaactttagggtatatcagaatcacagatagctgaaaattttggcctgtccaccaagccatttggcctgtggacaagtcagttggctagctggtgctgagagtgcccatagtaaaaatggaatgatgcccagcaaaagggaccctccagggtttctgattcagtaactctggggtggggccaagaatttgcatttatagcaagtgtccaagtgatgctgatcctgctggtcccaggcccacactttgagaaccactcaggggattttggagaaaataaaaggccatcccaggtagctgattggtatgcttcttatattgttcacctaactctttgtgcagtttctgccctctcactttcagggagagagctttggtaaaaatgtcaggctgcacacttgtaatggggatgagttgacctgcctatttgtttactatgcagaggaagtccatttccctttctttctctgaagaaagcccagtaaataaaaggcaagcaatagaagggaaaagaactagataaaaggaaaaggagagaagcaaagaaaaaaaaaaaacacaagccatacctacaatgtttgaaaagctggaaccagggaggactgtggacttcatcctcaggcctcaaggaataactaagtgatgagttaggggctgagagacataggtatagaatctcttggcatgtcaggagagtcacacacatacatctccctgcaaaagtattcagtttcctcagtccaggttttgaaaagctatttggtattagtggccagtctctgagttgcccacccaatgtgagaagagaatggttttgtagaactattgcattttgataagctcaccaatgttctggctttgaagtaggtgtcatattttcttttctgttccatatttactcagaggcagtttcttatttgatgtggtccttatattttgctttggtatttgttatatttcctgcttataaacttgatatcatgaggtgtttatttttataccaggcaagagattctttaagaatgattaatgttacaaatacacttttggcttgttttttcattgaagttcctgaggaaagcttcagaagaaaactagtttgccatttgtagttaagagattaaaatctctaaccttaggctgtggctgtatggtggccaaaaagtaaatctgaaataaccaggtattctcatttacatttttcagtttttttcatgttgtctcataaatatgctatatttattattaagtccattatgcatgtgctctctctctctctgtctctctctctcacacacacacactcacacacacactatcagaaggaacattgaaaagagtctcatgatgttattgtataaatcctttagaaacccaggatcaagctggatactcccaatttgtactactgtcacagagaaacacccaggaacttattttcagaaaacttatgtgcttgcttgtaggggtgtttgattatgttttttggcctcaaccattttccaggcagctatagtgcatgatcatatagataagtgaaaaggagaaatgaaaaaaaaattcaggcccaagtaaaataacgacttttgaaaacacctgtcctgctcttaggttacaattagaaggcatggttaactttggcttagattcttaagtaaaaagttgagggaaatctcatgttttagacttcatgtgcacattttttccagtttttctttattcacctatgacagagagaaagtgagagagagaatgagagcatgtgtgtattgtactgactcctgagaagctgttggtttaaattttcatttttttcctctctcagacacctatgtaagtgactttgtgacacagctttcctttcattggcaaatgatctgagatgccacattccccaaaagaaattcaccctatatacaaacacgttttccaatttaattgtgttttttttccagttttcaaatttactggaaaagcagttatttaaacactgaaaactctcgtttttcctttttttttttttttttttggtgttggtttcagaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaagtactccttgtcttctctgttttgtttttgttttgttttctttcatgttaaaagaatgtttgggaaaggtagaaaaataaatcaccaaaattctgttggttcaatggcagccttttcttcctctcttacctcttctctcccacacactgtccttacacgtgtacattttagagttactaaacaatactgtgatcagaatcttcacctatcattattattgtggggtttttttgtagctattcttagaagggggaatatatgtttactcaggaatcttaatttttaaagtaggttaatactgccatacccattttagctcttattctacttcctttctgcacaaacaaacatacacacacaggctccacatttggttgttttgtgtgactgtcagcctactagtcatagtctaggaaagcatttaatctctgtgagcatatgtttccttgttagaaagtgtactcagagctctttggaagacaggtttctacgacaattagtgtggactacactgctgttgactcatgactctgcagaattaccaatacagaaagtgaaattgtagtatgtgatcaggagctgatgaaatgaacctgtttcctcattgggaaattcagcgaattggactagatagactgtgttctttttttttgggaggtggggacagggtcttgttctgctgcccaggccagagtgcagtggcaggatctcggctcacttgcaacctccacctccggggctcaagcaattctcctgcctcagcctccctagtagctgggattgcaggcgtgtgccagcacgcctggctaattttttgtatttgtagtagagacggggtttcaccatgttgttcaggctggtctcgaactcctggcctcaaatgattcacctgtcttggcctctcagagtgctgggattacaggtgagagccaccatgcctggccgatagactctgttcttgagcaggatattgctttaggggcctcattgagcagaagcaacagagaaggaagtcttttgtgggtgagaccgtgcaactgtgcctttatctcccagttccaccagagaatctttgctttctttgacttcacacagcagggatctgagcaagatttcaaggggaaaggggttccactgctccttcactgccactcccctcccccaaatgaaatctgaaaacttcttgaagaccccaccacctctacctttccatgagtcaataccagggaagaaacataaatatactggggcaaagtgatctttgcaaggctgatcttagtgctgtcaactttaggccctcaaagggaaagccaaattgtaggccattgctaaaaagcctggatgcacaacaacagcagattctgctgaggccatttggttgttttgaggactggaagaatggacagcataaaaactggacagcactacaaacatgaaaatagacacctgattgcctctcacagtttatctacagttagggtgaccatataattttttatccaaacaggacacttactgtctaaatcgggaggtgcttattaacaaattattcacagacaacaggtgtcactttttttttttttgatagagtctcactctgtcgcccaggcttgagtgcagtggcgagatctccgctcactgcaacctccacttcccaggctcagacgacaacaggtgtcactaattttttttttttttttttggaatctcgctctgtcacccaggcttgagtgcagtggcgagatctctgctcaccgcaacctccacctcccaggctcagacgattctcctgcctcagcctccctagtagctgggattacaggcatgtgccaccacactcagctaatttttgtatttttagtagagatggggtttcaccatgttggccaggctggtcttgaactcctgacctcaggtgatctgactgcctctgcctcccaaagtgctgggattacaggcatgagccaccgtgctggccaggtgtcactaattgttagtaagcaaccaggactgtcgtggactggccaggatacacgggtcactctagttggagagaaaacttatattcaccagagtgaggataaagattctaaagaatggtttattatgaaaaataggtgctcatgggatttttcatattagaattgggtgataataaggattaattgattgattgcattcattatgttgtttgttctctctctcatctccaggccataaactgtcaggaaacaattctttctagtatgtttttgttcactccttctttgatattttcatcgtaaattgcaaatatttattggggcatatgagggtggagttgagggtaagtggggagatgattgttataattaaaggaataatatctgattcttgaacttctgccaaccccagcaaccattattaatcttggacatacttttgtcagagtccctaaaacagtgcacagtgaatcagatcaaagttatttgcattgtggtacacccagcacatttgccctccttcaacaattcctcatgttcatcctccactgaaagggcagaaagacactgctgtgtgatttggacatctgtgcatgcatgtgcatgtgcgtgtacacttgtgccaaagagaaagagagtcaagagccctttgctagtttgaaaagtactttctttatgttaaccctctccccttcctttgagtttcagtgttgattcttggagaaaaagggccagacagcagactcaagcctgccttggtgttagcctcactttgcaaggttggagctattttagagaactgaacctacaaacatggatggggagggtagccaaactgagaagtttagagacaattgattgcaggttagaggattgaaggctagaaaaggcttgcctttgttctgcgtctccctacctcccaggttacggggaagtaagcagttgtgccttccctgtgttgcattcttctggacgtcgttctcagaattaaccatgggaaaccaagaagcttgactttgatatttaagattcagacacccttacttatgcaacaaaggtatgtgacccaatgtgaaatagtcacaatcactttttctttctcctttcttttttaaaagaggcaggatcttgctctttcacccaggctggagcgcagtggcacaatcatagctcactgcagccttgatctcctgggctccagcaatcctcctgcctcagcctcccgagtgagtagctgggaccacaggcatgcgccatcatgcctgggtaatttttgggtttttgttgttgttgttggttggttgtttgttttttgtagagacagagtcgcgctgtgttgctcaggctggtcttgaactcctggcctcaagcgatcctcccacctcagcttcccaaagcactgggattacagacaatcactttctgatgttgcttttggtgtgaatttttcttaatagaaaaaaaaagatcccctgtctaccttagtattgttaaattctttgagaaatttacttttttttttttttttttttttgagacagagttttgctcttgctgcccaggctggagtgcaatggcgcaatctcgactcactgcaacctccatctcctgggttcaagcagttctcctgcctcagcctcccaagtagctgggattacaggcatgcgcccatacccgactaattttgtatttttagtagagatggggtttctccatgttggtcaggttagtcttgaactcccgacctcaggtgattcgcccacctcggcctcccaaagtgctggaattataggcatgagccaccacatctggccttgagaaatttactttctaaatataaccctaacaatttttgtttttagacttgatctctattctatagtcattgtattctcatgttagcctaagagataattgtgtagttgtatgggaagaccgtgaataggagcaatatgcctgaatttacatagagtgaaacataacttgccaattgtttagctgaaaataaagttttgtggctactttaagtattgtggtcacaattgggaatgcctaaaaaagacaatgtttttgctttacaactgagcttctaaatttaaggactgacttgaaatcaaaccctttaattaaattaattatattatctaaatgaataaagcatataggcatcaagtcagtttctaaaggcgctgaaacaagaattctataaatatctaccatctgtggaatgcatctgcatacaagcatgcaaggcatacttgcatacctgagaaaatatttattacattaatttttggagtatgacagccagttaaaaaatttgagatacagtggtattggaaagacaataaaggatctggctatcaaaaacagttcaaaatgaacatgttgaaaaattcatttgattaatttataaataagattctctaccagtttggatacccaagtaatgttttttatatatatgggttcccacctctgctaactcctgcccaagaagcacagtttgcaggtggatctagaacaacccaagaaatgaacatttcttcttttggtgcccagtaatattaattgcttcgggcctgaaaaaaagacctttcaaagtaagggatgtgttccctaattgaagagagccaccccatcagccacctcgtctacaaagaggtctttctttctttccttctttcttttttttttttttttttttttttttttgacatagggtcttgctctgtcacccaggctggagtgcagtggcgtgatcatggctcactgcagcctcaatctctgggactgaagcaatcctcctgcctcagcctcccaaatagctagcactacaggcacgtgccaccacacccagctaattttttattttttgtagagatgggggtctcgttatgttgcccaggctggtctcgaattcctgggctcaagtgatcctctcaccttagcttcccaaagtgctgggattacaggcataagccactgcgcccggcctacaaagaggtctttaaagtgaaatatgaaaagcatcatggtcttgtttgcatacttagagatgttcccactttctcttcgtgagtggatgtccagtttacttttgcagcaaaggggttgcagttaaaagttgagcaatgatttgattatcactgaacctttgcaaggccattagcaccagcaagcttaagttacttcaagagaaagacacttcatagttgaagtacacttgccttgcttttgttttttctgggcccacatctccagtgatttcagctcactccattgagctttacaattcaaacttcccaaaagcccctttaattagtaacaggtggttcaagagtaccctcgtactacacatctttgtattacttattccatcgttatttgtcatggttcatgatacatttcttatttacctgcttgtagcagcagttttgcctggaaggatgaagtctgttgtggtctttcagaaatgcacaagtggttacatgcatcatgaaaattaatagctcctatgccaaagagagttgcattctcatggtttcagttaacactgacataatgggactatgtctacacctacaccccaccccaaactacagaagctataattagaaatcagtgcctcaccattgggatgtctaaatgactgtcctgccttgaaaacaattttcattgctccctctttatttctatttgccttagttttgcatctccccacctcccaggttaaggggatgtaagcagttgtgccttccccgtgttgcattcttctggacatcattctcagaattaactgtgggaaaccaagaagcctacaagagtactaaacaaactattttaccacttcccaaaatcattataaatacaaatttaaaaaatagtcaatacaaaaagcttttaagaagcaaagtgtagacacatattcaactctcaatattctttttcactcacaatattaaaatctagaattgcaaagaggaagatgggactcaagctatggagtggggaaggggtgaggatggtaggagtacaggaggtgtcaaattgaatacattgagtttacatactcacaaaacaaaaatagagcccttttcaagggggttgacttataagtgttaactgagtctaatcatttgaaacaaagacaagacacatttcaagtatttatgaagcttcaattttatctacaacatctccagaaatattcctgactgaatattttgttatgctttttagattttgttattagaggaatcattaggaacttctcatcctcctttctttgtgtatatgcattgaattcaaaactggttaggaaattgttgaagaaactcatcacatcccatggcaagtgtgggttccctatcactcttaccgtaattctgggaatagttctgttatttctattgggtgcttttgttaccaagcaacagataaaatctagaccttttctgcttgcttgctactattggctgtgcaaaaaacaaaaacaaaaaaatagtgcaatgaatgtatgttaggaggtgaaataaactaaaaggaaatgcatttctagcttcagtacagcgtgttgactgtcatcactgtgtaatgtggcttaaggctcgttctgaattactgaaatgaaatccaggctgtgtgaagagttctgttccagcattttttttttcaggctgcttgcagtagtttttaatgtggtgtttggaaaatgcaggttattgggtagaaagtctcaatgtatatgaaaagagtctttgcagaaaaggctttttatagcagatatggcatgcagatgtcatgataaatgtatatatcctgaggaaggcaggaatgagtatttttaaaagagttttaataagttgagaaggaaatgaggcatcttcccccccacatacacactgacttttatcatgaaacatagattggctcctaaaatcttaaattttaaggtacctcctacagttaccttatcattaagaaagacctctgtcagtcttgaaggattttataggcttggaaatttggtatcaatgtattgtcattatgggtcaataactcagattgattttgatatatgagttaatatggaagtactcagtccagatgatattccctttctatcataccaccccacaaaagcaaatgaagcaaacctaattcttatgtaaataatgtagaaatctttttatttttatgcacattacgtaccgttttatagtaggaattgatcatctctgctacattagtatagttctttcaaaacattaaaattggtaaaatatgtaattgttttctggttggttttgttcaagtgaacttttttctcttcacatccagcagtgttttcttgagcctttgaattctttgtgagcagggactgatgagtaatacacatatattcatatcatttttctcacctgcggcaccttgaatagttctaaatacatagcactggctcagtaagtcattattgttttactaaacaatgttatctcatccaagtatctagtgagatattgctccatgtagaacagttgcatcctaaattaccctccaacataaaaattgattcatttggtcaataaacattgaaaactgaaaattgtcactagaaaacatccagctccatagtggagtgtacattgtacatggagatactgtactagttctaggagctctggtgaaaggattaggcttatgtactgccatcaaggttcctatagtctgttactcaaaagaagccatttaggtacatagcatggaagtcaagtacacctactctggaaccaaattgcctagattcaaatcctggtttggccatttactggaagaccttgtgtgagtcccttaatctctttggggctccacttcctcatctgtgaaatgagataatactcatgttatgtgattattttgaggcttaaatgagttaatacatgtagagtactgagaatagaacctggcacatactaaatactgtgtaaatgtatcatagaaaccaataaaatccagtaaaatctatcagtagtaactctgccatagaacagaaaaattttctcttgaatcttgacatcaaaaccctcatgaccacgaaaccataaaagctaaataagcattttctttaagagatcattaaaccattctttttatttaaagggggaagggaggagtgtacagtttttcttttcccatttcttcatatgattttaataaataactattaaatcattaagagaggtctgaaaaatgtgactttcgtaaaaagtagtcataactcctacccctgctcttaccccagccccaaggattctggaacttactaatatctaggctcaaccaacccttctaaataaaagaaaaaaacatatcaaatgttagtcaagagctgtgccccaaggtagcaatcaaattgaacaatttaagtggcacaccatgccatgccatggagaataaatacataactgaagattaaaggaagaccttttcgttaatccctgtgtggcatgatctactgcttggttttgggtcttacggaataaatctacttcagcaaataagttttggaagactcaaaagaagtaattgattttgagggttaccagggagtagaatgttgaatgaacttgaatttctattcaaaatgaataaagccccagaacaaagtctgacttagtccactgttatgtttgcttaagggtgagagatttgcccctaatagtgtggagagaccattgagagctaatgaaagagcccccagcagtgcctggtatattaccatgtgacagtaagtgccaccactggatccagaagatcttggactttcaccagaagctccacgagagaacttaaattaaagttgcagattgaacatgccaaatctgaaaatttaagatccgaaatgctctaaatctgaaactttttgaataccaacctgatgcttaaagaaatgctcactggagcatttcagattttgggtgttcggtttagggatgctcaaaccataattataatgcaaatattccaaaatccaaaaaaaaaaaaaaacccaaacacttcttgtcccaagcacttttgataaaggctactcaacatgtgccatatactgtgtagctttttcttccatggtggtggcatacttttggctcttaaagactccaaaagagaggcaaccattttgtttactcactagggtagtccagagtccttgacactctgggctcactgttctgagcctgggcaggtcgacaagggtggggaccaaaggcctgggcagtgctagcattattgctgtttcttctagggggatgagactttgcaggggagacctgtttctttaggtctcgtgactgttttaaaactcttccctttatattagggcctcatcccactaaaacggatttgcttcccagattctgaattcccttcatgtgaaatagtgcatggtggtctgactagtggttatgagacaaaagacagattttttttcctaactttgatattttatatgtcctttctctttccatttttcttataacttcctcatctctcttttcagttctggtattatttagtgtttccctagcatgttgtagctgagttgcctgtgaccatttttagtagttacacaacaaatcatgtacagagcatgagccagcacttagccaaataatgaaatggaagaactctgccaaactcagcatcataatttcccttaataaaactctactgtgtcatttagtttggtctctttttaaaacttgagcctccatcagcctattttaggggagggtactacaaggtctgttgcataaatgatttgacttgcaattgaactaagaatacaatgaaccacttcctagagttattttttaaaagaatgagaaaggacttctttgaaaaaagaagtgttttctgaatataactattttgggtctaaaatttttgctcatttcctaaagtcctgtaccacattggaattgctttgtattttgtagaacaggttttgtattctaatatagaaattcttaacttgccttgttacctaaattcaaatgcattccagaataatccctggcacatagtaggtgctcagtaactatttgttgaccccttagctttctacgtttcttcttacgagggcattgtctcctcttaagcataatattcaacaaatgccacgtgctattcagtgatttttcatttcatagccacttgcataacttttacctctttaaaatctagccattttgcagtctcatcaatgtggaacccaactaaaactaaagtaggaaataaccagtgcctaagattacagtttcctgtcatctggcagggaaacgtgatacatctgggaaatcttttcatcacaaatgcttgataaggtatagtactggaatccgatgttgtgaggtgactgtcagcaagttgcttaatctctttggctttggcttggtttttcttatctatcaaatgtgagagcaacactcagtgatctctctggtcccttccaactctaagacttctgtgatcctatgcttctcaggccacctcccccctccagtcctgtttgctcctttacaaaaggagagggggacatgtagggaagtcttaacaatctgtgactttaaaggaatgaactttcagctgtccagcaaatctggctatccagaaaaggccattcctccagggtatattggttagccaaaattttactgtacattaatacatagttaggactaatttagtgcctaggaaaacatttgggaatggttaaaactgtggaaaaatcttaattcttggtagggcagtgtatacaattaccattttattgttacacgtattccccccttttaggctagagccttgtttgggatgaggggaatggatgtgcacatgcatcacgtaggagcctgactgttttttttctcctgacaccactaatcccctgttcctgttcctaagggcactgctgataagtgatatccaaagtaacactccagagcaggtgaagtgcattgccgggctgccctgcatcccagcatctcttccctgtggtggtatctgcctccaaaagtctgtgttagcagaactggtgggtacttacacagaagaatgcactaatcctctgatactgactccaaaagaggagggtggggcagagagaaagaggagacaggaacttttaattagctgctagaatgctatacctagccccaatcctttctaagcattgaggaaaacaagtgaccggatggaatcagctcttctacaccccaaataatttcactttataaaactagatgaaatgaagtcccatttctctggagaggacagccagcccaatctgacttgggtaatgtttctgtctttcttcctttccttcctcacaaacttccagtcatagccccatgtgtcctgccatatggtgtccctgtttgtttgtttctcctttcttcctttctttctttttctttcttcctttcctttcctttccttcttcctttcttcctttctttctttcttttgagacagagtctcactctgtcacacaggctggagtgtagtggtgagatctcggctcgctgcaacctccgtctcccaggttcaagcaattcttctgcctcagcctcctgagtagctgggactacaggcacacaccaccatgcccggctaatttttgtatttttagtagaaacggggtttcaccatgctggcaaggctggtctcgaactcctgaccttgtgatccgcccacttcggcctcccaaaatgctgagattacaggcgtgagccaccgtgcctggcaactggtatcccagtttctgcctgatgtttaagcccctctaaattctggccacacgcatactcctgtgcacctgaccttatttcccgcaattccccaaccccattctgagatgcagtgacatgtcctgtactctcctacaggttttgttcatttcattgaacttaactcaggatgctctccctttgtttgaccacttaagtccagcccctttctcgaaaatttaaccaaagccccacctctttcatcaagtgttctgtgaacactctgtgctttagtactcccaagccttggaaaaccttcacacaccccctaagtttaagattactcatattctgccttgtagaatatattaactttgccttctgcacagctcttggcacagaacagaagacaccgtaggtacccttctaaaccttaatttggggttagggttcaaaggacagccttgtagtcaatgtaatgcagaagaagatgtgcttctgttccagtctggcaaagacaaacactgatggttgaggctattagcaggacgtgcatggtgggcacatgaagatagtctcctccactgcatctcatggctcaccctgcatagttatttgtaaaaggattttgagataattgagcaatttatgtgtgtgtgagagagagactccaggagggaagggggtgggggaggaatgggtgtttacagggtgggagttggtgcaccttgtttgttttgggtcatctccctcctctcccctgtcccaacatgtatcttttatctaatctatgtcttcaggaggcagtccaggcttactaattgtgatcaatcacaactcattcttaagttcatggccaagccttcagtgtcaatgtgatagaagcaatttctgtctctattttagccccgccactactgtctttttttcttttcacacattaggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcataggtgagcaagtggttaacatatttgtgttgctggagatagcttagcttccagtcacaaggaatgttgtaattggcagctatgaaatttgtttgtttaagtgtttgctatttagtgtttgtcagaatcctgactacgctcaactactttgagaatagtaaaaacattactgcaagtgaatgttccctcaaactaatggtggcatttctgaaggtaatagatacagtggctgccaggttttaataatgagaaaatgcctttttcttggagacagagtctctttctgtcacctaggctggagtatagcagcacaatcatagctctgtgtaacctgaaactcctgggttcaagcgatcctctcaccctcagccccccaaaagccctgggattataggcatgagccactcactgagaaagtgtctttttgatatttcccgcctgaaagtcagttgtgtttatgattataggcttgtatccatgtaaatgctggagtacagtcctcatggagttgtaaaagtggcttttaaaatgttatatctattacactgcaactaaatcttctgcaaaccggccagatacgcatttgttatttggatcaggtgaaatctgattgagaaattcagggattctgtttctgtacaccatttagcagtagtagtctgctctggtgagagtggaaggactttagccctgagaatttaagggatacatattcctgcatatatattccacctagaaaaccattctcagaacccagacagcaatgtaaatgaagtggccaattgcagagagggttagttatgattttggggaaaggacaaattaaggagaatttaaatgtccagttgtcaattaccttgatgcctgaagcaacagtaaccagtgttgaagttccttatgctgagtattagtaggaccgcacacacatactaacagctcacaaaaagaaactcacatttttccccaccctagtcacctttgcataattgccgaatttgagtgtctttataagcacctgtttttcacttatttgtccaaatcatgggaacatgtatgcagtattctggcttggttttttggggggaggtgaggggtgttaatgttggggaatgctttttagtctgtgtgagagctaattaccatattaactccgtttgaaagtgcatcaataaattggctccaacagattcttaagaacactgacacagggggataaaaaaagatgtgaatattaagcacttcagcacaattgtagcctaaatagctcaaagctagaagacctgaaaaaatcttctacacacagaaaagcagaatctcatgaaagggaaggcataagaccagcaaagacatacaggccaaatggcacatcatgcccagaatgaagccatgggagaaattgttgattcaaaatatttctcatggaagtaaaaacccatagaatttccagatctaaagtcgctgtttttgttttctctctctctctttaatcccacactcatccccacacccaaatgtcaagtttgcagttcacttttgcaaaattgaatttttaaagaaagttggtgatccttttcaattgcccctataattcactgtttctccaggcaaggtagtagaatttgccatatggtacaaaaaagtgtatggtgacagtgatcgaattctgctgacttttctacagacacattgggaatggaatgcagaagggcatggcccttgccactattttgatactctaacatgtctagcagcaactataactaaactcatatccttatattaaaatacaaatgctcctacgtgtttttcctggagtttacaggtccatatcaaatcaaaaccacactctggctttctttattgatgttttaaatcagttactcgaaaacaaagaggacttaagttgctgttgttgttcttgttgggcatttttaaaattacatttgttatctttgaagaaacaaacccaagtagaagttgataggatttctgaatcgatttttccctagttattttaagtgataactttttggagggatgaggtatataattgtatctaaactttgtttttaatgggtatactattctttatttctaataagcagatataaaagaccaggagtaatagacattgttaatctccagtgctttttcatgaatttttcacaagggtttaattaatctgctttgtggttgtagaattcagtcccaatttacatgcctctgctgtaaattctttttttatttcttgtctctctctctttttttttttttctgtttgcaaggaatttttctttcccctttaaatgactgcagctaatgaatggtcaagggctttttcccccttctttaaatcagatcttggggttaagtcgggaaactgccttttgttcttccagtcaggtcgggaggctgaagatgtgggtttctgattattggcagcacaatgcaaaaggaatcgctttccctagtgagaaggggatgctttgttgctgggggtatggggggaaactcagtgccagtgtcttgagcactgaaataatgcagttggactagaccctttaagagactaaggatgaactggttttccaaatccgtcttcttgttgccatgctcttcctctcctctcttaactgcatctgcaactggccatgaattgagaccctttagtaaatgttgaagtcttgtcagccttttatcaggatggatccaaatagttaaaacaccttagaacttggttttataagacgctggtttatatgaaaccttcacttggaaatataaaccaaatacctcccttgcccccaccaacaaaagtcagtttctggagaatcataaattatgctatgcaacttgttctccatcacatactgtagctgtgttaacactcatttgactcagggccaaccctattaatgtcgcatgttgctgccagtgggaatttagtattgggattgctggcggggacaccagccaggtcctggcaggaggcaggagccagtcagatatcccgcaaacaagggcctccgtggctcgtatcagccagaagaaaacccaaactccaaaccaatcatctttggctttctcttgaggcttcttatcagggctggctgctgttacagaagagccaattgatagccaatcatgacttcctccaggggttagaggcagctttggctcccgggctgcagagtgcaggcagaatgctcttcagttgcattcttcagctgcgcaacacacaacaccatggcaccggccccaacaaaggcccagcttccccctccattcccaggctcttgtgtatagccggctggctcagagtttacaaagacgccaaacagccagaagaattggggtttatgtttcctttcagtctttcacaaacacattagtgatctggccattccttgccactaggggaataaggagttacaaaatgcactgggttttgttgttgttgttgttgttgttatttaaacgtctgcattttagatgtttattttctgtctattcataatatttttattgggagcaggtgatttcttctcagcttacgaaggaatgtgctttctgtacgtggcagccctgatgatttgacaatgatgaacacatttaagttgtgctccacttgtttacaaaagtctccttttgctagcacatcaaaagcattttttttctctcctgtagtacaatggtatattcatgctttcagcccttacttagagttagaagcatcacttgattggcgcttaccacaatgcattctgaaacttcatttgttattactgttttaaaaattgcatttcatggaaatctatttgtggtttgtgacatcggaattgtagtttagagaaatgaccccgtgcattaaaatgttgtgtagcatttgttctaggttgaaggtgaaagcttgatgactagatttggtttcattgatatgctgatgcctatgctgctttccactagaaagcttagatagaagctcagctgggggctgcaattgtcagctgtgttctttgggtaggacacaatcttccgggaactagctcttctttcaagtaaccatccttgcactacctgaagatgatagataatgtgggtctaactcctttcttgccatgcactaagcactagagtgtaaaggggggataaacaagtttaaaagttcactgtttgtcgttaatgaagcatcctttttgtcatttggggttttcatttccaagttcttctaattttgtaaaacaggtagcaggcaaaaatactaagcctcataatcctaagaaacatatatggcaagaaaacaaagacaatgtattttattgaagcgattcagtgcttactggaaaatgccatgctactccagagtctaaagcaggataatcggtgaagatatatactgtgagcccactaattttgtgtactgtatcttgtgtcatcttctcacttgcaaaaaaaaggaggtacatgccttaagataaattgaagccattgtatttgcaatgagaagtttttcttaatacaaaaattggattattcaaagttttagtatttgaaaagtcattagaattcctaggaaccctttcatttgtattatccaacggtgcactcaaggatctgaggggttttgtttttaaaaacaaaagaaaagaattaatatgccagcatcttaactgatttatgtttttgactcttgtaaatggaatgtgaaacgagaagatcctagggaagtctctgggagagctggcatgttattttgtctccagccttaggtttgtcatctgggagctaactaagagccttacagtgacagtggctgacacacgaataatcagtattgaggaaagttcctgattgggtttccttgctgtagaactaagccttcatctggccatttcacactttagagagctagtgatacatagtgactaaatgcagtttggtgtaagggaaatagacataaaaacaagaattcattatgatccatgccttacttcccctgcccccatgcaggaaacagacagaaaaaaaaatcagattgatttacccaaggccaaactaatgattgactttttatgctgtattgttcttccccaaacctcatattagatgctatgctgatggtggcagagaggctagagggtcctttcaacattgaatcggtcatggatcccatcgatgtgaagatttctgatgctattatgaacatgcaggataatagtgttcaagtgtctcagaaggtaatgaaggcaggatgctggaaaggggagctagggacctcccccgcctccgcctcccgccttgggagtgacttccctaacatgacgacacttactctaatgcaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggtgagcgttttggcaggaagggccgtgtttaatgacaaagaactgaaaactcttgctcaaaatgaatttttagctggaaggctaacaagtgtgggtctttcaggtgtcacttttcaagcaaataggatgtggatgtcagtcaatctgcctgtcccattttctagcccagaaagttcttgggtagccaaggagttatgatgcaataagtcttgtctcaaaatttctctttagattcaccatgcatttattgaacatctactatgtgcccatcactgtgctaggcatagagaagctcagagaaataaggcagatccttgttctcaaaaggcaccaacaaggaggcaaagagggagaagtagatgttccaggcttattaacataaaatgatgtttagtaaaagctgagatgggagaaaagtgagtaactgtaggcaaattgctttatccacagtaatatgctacaaaaatgtaagaaactattcctacagtagtaggaacacagaagagggagcctgaggagacagggatggagagaaagagcaatagcagctatgtttcacagagtgcataatatacatgcttgatcctgactctaaaagccttaggagaagagactgcatgttatctttgtgcctacagggcatggagactggtaggcctcagatggtacttacaatgaggtgggcaaggggtctaggccactcctttggagcttgcatttcaactattatttgagtggttttgtacttctaagatataaattggagttgcatcttcctcttctaattaaagttgaaaatgaattgcatatcactctggagatactttggaaatggccagaaggcacacttgtaggtagttttgtcttgtcttacaatgatctttttttgttgttgttgtttcataattaggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggttagtgtctgttgaatgaatttgaagtttctcccttcctagatgcctgggtgaccttcagagagggttctctcaattgtcaaccgaggcatcaggaagcaattcacagtaggtagcaacaacatggaaggcttctaggtgttcttaggaacaggctttgcactaggagtgttgagaaggcacccagttacttacaaagagtgctgagtcaaaagtttgacagtagttatagtctcgtattagggctgttccaatagtgtcattatttttaaaatatttaatgcctgtggctctttgtccaatggcctagcctcataaataaccagttctcaaaggttccattctctgacttgatgccctgtgtccctcccttagacgctcagtaacttagagaagtacccatacttttttttgtttgcttgtttgagatggagtctcgctcttttgcccaagctggagtgtagtggcacaatctcggctcactgcaacctccacctcccgggttcaagtgattctcctgcctcagtctcctgagtagctaggactacaggtgcctgccaccatgcctggctaatttttttttttttgtatttttagtagtgacagggtttcaccatgttagccaggatggtcttgatctcctgaccttgtgatccgcctgcctcagcctcccaaagtgctgggattacaggtgtgagccaccgcacccagccagtacccatacttctttacttcaacccaccatcctcctcaagagggatagctagcttccttccttccttccttccttccttccttccttccttccttccttccttcctccaacagagtatcactgtcaccctgctagaattcagtggcacaatcttggctcattgcaacctcactgcaatctcagctgctggaatgcagtggtgcaaccttggctcactgcaaccttcgcctcctgggttcaagtgattctcctgtgtcagcttcctgagtatctgggattacaggcacacaccaccacacccggctcattttcatatttttagtagagacagggtttcgctatgttggccaggttggtctcgaatgcctgacctcaagtgatccacccaccttagcctccaaaagtgctgtgatagctttgaagaaggtttccatcaaattggagaaatgaggaatccacaggaacaagaaagattagagttcattaggaattaaagaacttccatctaattttgcttagtggaaatactagaatctagcagaagtatttgataacctcttgtataatcttcataatcttcacgcctgtaatcccagcactttgggaggcagacagataaaatcttttcgctttacgaatcatcttactggggtcattttacattccaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtaagcatttgtggtttgaaagtacgaattgctcttgtatgtcttctgatgagaacaagtggaatgaaatttctattccatttttttttaaactaggtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatatt

SEQ ID NO: 5883 - DNA, 111919 bp, human
agtgcgactgtcgcgctccgctccccgcctccgctcctcctctcccccctgcattattcgccgtcccgggaagcccctgaggactgtggccctcaaagtgcgtgtcaccggctacttctccttttccgggttgaactccttataggacgccccgctttgttgtatgggtgaggagaggccgggtgggggtgggggtcgccagtggggtgtggtggagggaaacgtcccggagcttgctagattctgggggtcgcaaaacgtggaacttgaattgatgtttcattgatgttcttttaaaactctctccccgcctctcttgcaccgctgacaaggattaggagttttagtagccgcaaccgcttcagaagtcgcctttaaaaagcaaacgactacccccactctccacccctccaaaccctgacttttgggaactctcctactttccggaaggtatcagaccagaggagtatttttcccctctttcttttttcttacctcattttaagggttaattgcactttcaattacagacctttgaaaggactgattacaggaaacctgaatctcagtttggagatggttatgcaaatagagacggcttagcctgtgagaaagttcaccggattttggcgccggtggggtgggatggggggtgtatgggggtatttgtgaaagcccctctcggagcgctggggaggcagcgttcggcgggtgccctgcgtccctcccagcgaagctggcggcggtgtccggccgggtcccctccgggtcgcactgtcttcttagcagcggccaactgttgcgcgcagccccgccggccgcgcaggtagcccgttcgccctgggggctcagaaagcaccacgaatctagctggctggtggccagcgtaatctaacggaggagtgagagattcgagcccggggggggggctgagcctccactccgaacctttcatggaagtgagtggagcgcgcctttgccttgccgtgctggtctccgggtggggcgggcagggggccggcagccagcaaaggaaatactgtaatttcaaccaggcgcttccaaaggcttaggaagatttgggggtcattttttggaagggctattaataaccttggagattaagtgcagtcatcaattacatattaattacaaaggtaattgagggaagttgctgggcacttttggagtgtaactggcgtctgtctagaaatagaagcgaagaaattgttggagcagcccaggcgcccactgcaccttggcagttaccaaataacatgctcactactgattagacactgtttgcccttcagctgcctgtcttttggggagctcaagtatgtcctcaaagcggcacgattttattggttgtagagccctgaaaagccctctttctttcccttcctcctgccccgccagaaaaaaaatgaagtgaaccaccagccgctgaagcttggggactctgcaggtcaaacctggggtctttgtgccctgcacagtttaggcctgggcacagcggagatgattggcgtgaaggttacagttgtcattcccacattttgaaggggtagatgcagctctgcacttaatgggaatgtgacaaggtttcatcttctgctcatgcaaacaatatgtgcctttgatattgactgcaggcattcagcgagtggggttgtgaaactgccctccccagtttccccaactttgctctgtgcagtctttcgctgtggcagggcatcttccccagccagcatctcaggaaaaaggaagcttgaagggtgctcagagactctgtgctaggtgttccctttgattgtcatcatccccagaaatcacctgagggatattttgcgtatatgtctatctggacattcccccatgccaaagataggggagttattagtgaccagcagcaggaaatggaagctaatgtgctcacacccaaaacattttattctttttgtcttgtccttcatctccctccctgggctgctgcttttatttccccttttgaatgacctactggactgcattctcctgaggaacaaaggaagtgcctttttagctggaatccttggaagaccaccaaggactttagctcatgcagtgcaatttcgcaccactttcaacaataacaaaaatgcatgactgaatggctcaaaaatgtggagtgttagaggcattcatttgagtctaggacactgtcacaacacagacagacccaagtaaatacctttagacggccagtatagaaacaggcgtaatctttaccatcaccctggcctctccagatgcatacattagccttgtcttctctgagctacactcagataattttggtcattttttaagggggatagtcaatatagtgacttgtattcagcctaggtctggatggattaattgccaggcactttgcctgggatggggaatgtgcttttttcagtgcaaaacacccaggatcattttccaggtgaagtatcacaaagtctgggtacctagctcattgagccccaggctcagcccaagtttaatgttttattccagatggccttgcacttgccttctagaggtttgaacaggctttaagaatactccatgttctggaggagtctcagtctttatagatcatagttaggatcatctgatgtgctctcaagggtgtcagggagtacatcatgctgacagggcttccaactgaggtcctgcattgcctgtctgcttgacccctgtacttttcaaataatgctgagtccaggtgccatgatcaaaagggatctttaacacaaagattatgtttttgttcagctttcaatggccatgtacttttggagcgcccactatgtgcagtatcctctgctcagcattgtggagacagcaagaaaggcaggaggggcttctgccaccaggacctttcctattagtaaggagataagccacgcacacacaaaattagaatacaacacagtggtgataagtgccatacaagcgatacagatgacgagaagggagtgcccaggcatttcaaagagagaagggatttaggactctaatactatagaatattaactgggtaaagctagttcactagtaaaaatgaaaatactaatgaagataagtttaaaaatctaaccattttcattatgcctccctccataaagacaaaggtaaagggtatgcaacaatgggcattttattactcatctatgttgaaattgtttttaagagtgaggcagtgggttagaagcattcatgaacttgccaaaggtcctcttcacaatgacattgaatgatactcagaactttgtgccctagttgcagttttggagtttttatttcttgttcccttctgtgttcatgagcaatgcacctatgatcatgtgctcacacacacatacatatgtacatgcacaaaggattccaggactcctataagctgttatgactacgtggaaaaaaagtacgtgtgtatgtgtgttggagaggtagcaatactttctaatagtgagttgattatatatgacacacagcatgtgtctttaagatttgtattccgccttccccaccgtaagtaatgtgttggattttgcaatgaatctgtgatctcctgttttgttggaatcatcaatttggctctgtgtttcacttggggagggtcgaattgagccacagggcctatcactgtagaaattgtcccaagtagtttacaggaggtatcttctggacatgttcaaaaaagaatttagttaaagttctggcttatgcagctcagtctctggttagaacatataaatataaaatgtctgattcagcataattactgttttccttttttatttgattcacgttgggttgcatgcaatttcaggattaactggagactagactgaggaatgaaaaaggaagttttttgttatgtgtacaagggaaacaacattggcgttaatctgaggcagttggaagtgagtctctctggctccccaatgacattaactgttttagcactgaggtttttttcttatttatgtttttaaaaatgtattttggcctcatgataagagttcgtagctattgaatgctttctctgggcctggccctataccaaggaacttacatgattgtctcatttaaaacccacaacaaccatatgacatcagaattatcatctccattttatagacaagaaaacaaattcaaagggattatgaaatatgttcacaatcttatagctaatgaataacagaggtgggatttgaacccaggtcttatctgttctagagtatagttcatgctatgttgtacagatagtaagacaagaaagtaccttctctattcccatagaggttgttgagatataaagtatgggaggaccctcagctaactagtaacagaccatcatcaaaacggcacaattttcgtgttatagtggagaggatccagtcacatcttttgtagacaaaatgtcaaacccagacatagacaatctagtgttaatggtagaaggaatataaattgtatttcctggacaatacaattgagccaatgagggtttctgagggaggggaatgtcgtcagtcaagctgttttaggaagataactagtggctctttgggttaagggttggcgaggcaagagataaagacagggaggtctgtcagcagactctttttaaatagttcttaactggtctacctgcctcttgtctgtccccccctcctaaatccctgttctatcctgaacatcgccagcttaatttccttacatcactgctttgattagagttattcctgtgctttgagcttcagtggctccaagcatctcaaatgatacttctttcattgagtcacttctgaactctccagggttatgtgcccacttcttcctaattccctgttggaaccagtccatggtctttgtacataactgccttgtattatagttaactgtgtgtgcaggtacgtgtttgtcttctcaactggaagcaacttgagggcaaagatgacaactcctcgtcttgtctgtgggtagcagtaccaagtgtggtaggtcagtgcaatatttgttaaacaagtgggagaataacatagccaattctattgtgttctctgtcagacactagtgctacaatgagattatactgccttgatgatagattgtcattccatggtctgttgatctcctaggaatcttttggatctaaacactttttttttttttttttttttttttttttttttttaaggcagggtctcactgttgcccagactggagtgcagtggcgtgatcttgcctcatcgcaacctctgcctcccaggctcaagcaattctcctgcctcagcctccagagtagctgggattataggcatgagccactaccgcctggctaattttttttttttttttccaagatgaagtttcgctctgttgcccaggctggattgcagtcgcgtgatctcggctcactgcaatctccacctcctgggttcaaaggattctcttgcctcagcctcccgagtagctgggattataggcgtgtgccaccatacccggctaatttttgtatttttagtagagacgtggtttcaccatgttggccaggctggtctagaactcctgacctcaaatgatccagcctcccaaagtgctggaattacaggcatgaaccaccattccaggcctgtatctaaacactttgaagtgaaataaatttaaagtaaatatgcatatgttggtatagcttggagaacgtttttattcttttgggggagtacttgtctttaccacttcattaataactgaatgcttataggatttttttttattttttgaaacagagtttcgctcttgttgcccaggctggagtgcaatggcacgatctcagctctccgcaacctccgcctctggttcaagccattctcctgcctcagcctccagagtagctgggattacaggcatgcaccaccatgcccggctaattttgtatttttagtagagatggagtttttccatgttagtcaggctggtcttgaactcctgacctcaggtgatccacctcggcctcccaaagtgctgggattacaggcatgagctactgcactggccaggaatttttcagaaagattcagaattgtttttcttaatgccttgagatacacttctttaaagaatgaacagttgagactgttgtgattaggcaatttagagcaaatttaccacatgcaactgttcagtgtgcatcagttaccttttaacataaaaaaactcaagtttattgtctttaccaagaagaacacaagctttgaagggtatcagaatattttatataaataaacagacatactaaaatacaaacaggtaaaaactagcattttcaaatctacttggttaaacatctgttgcttactatagagaacatgaaagtgcagaaaatgcatgaagcgattccatcctggaggtaatttgaaatattatgtttaagttctgatgcatttaattcagcaatctggtgggagagaaaaatcaaagagctgcatcagccaggtattcaacttttgagaaagaaactctaacaaatgttagaaattaggggaaaaaactgaatgggagagttaaaaaagtcaataacctccaggaagcctggaaactatgtaaaaacatcttattggaagcccagataaatgtgtgccagacatcaaaaagaccaactgctcgggggaagaaaaaaagaacccggcatgactaactggcagagtaaaagaggctgcttcagggaaaaaggcatctttcacaaaatacaaagagtttaagccagaagagggaagtccactaggtttcacaaggcccaggtacaaactagaaattaagtgggctgacagagaattgaagttgaatcttgcaagggatttgaaagatggcatgtgtgataataatggtgaaaagggtgggttgagtccaacctatctagggagaagcaatatggcttctttaagggtaaaccatgcctgattgatctctcgggattctttgtgtggaaaaaaaagcatgaggatacagggaagcagacatacatcatttaggtttttaaaaattatgcaatgggattctaaggcaaagaatattcagaaaatatatttactttgagataggtggggatagttggacagagagggagagtgagggagggaagagactccactgttgtagatggagtagtttacatggagaagacatggcttgttaggatgagtagttctagcctaactctggcaaatttgttgtcaaatacctttggtgaggttcttccctctttgaaaaatggggtgaaattgaaccacctggcacctgaggagcttttaaaatatactaatgcctgggtaccaccccataccaatgaaataatacttttttcaggaaggactaggccatgatggatggatggatggatggatgaatgtgtgtgtgtgtgtgtgtattttttttttttgagatggagtcttgctcttgtcacccaggctggcgtgcaatggcgtgatctcaacttactacagcctccacttcctgggttcaagcgatccttctgcctcagcttcccgagtagctgggactacaggtgtgtgctgccacacccggctggttttttgtatgtttagtagagatggggattcaccatgttggccaggctggtcttgaactcctggcctcaagtgatccacccaccttggcctcccaaagtattggtattacaggcgtgagccactgtgcctggcccatggtagttttttttaattttcttttttttttttttttttttttgagacgaagtcttgctctgttgccaaggctgggtgcaatggcatgatctccactcactgcaacctccgcctcctgggttcaagtgattctcctgcttcagcctcctgagtagctggaattacaggagcacaccaccactcctggctaattttttatatttttagtagagacagggtttcaccatgttggccaggctggtctcgaactcctgacctcgtgatccgcccgcctcggcctcccaaagtgctgggattacaggcgtgagccagcatgcctggcctaggtcccttccatctctgagattctattattctaaattttccaatgagattcatcacaaaatgttgtttgagataaagcctttagtttagaatcagtgcatggttgttttaattttggctaacttggatttaagagaaaggtgtgtcaaacatggaggaaaatgttttcaatcaagatataagtgtgaaccacaactgagtgctgctttgctgcaggtagagacataagacaagcacaatgagaatactttggaaagaattagaacagaatccagccttgctgtcatttattgattaagtgtcaacatgctaggtgatatttcttccctttttctttattggtaaaattaaaataaatctctttatcccttactttaatgtcctctttgccatgtgtttattctcttcaagtatcttatcaagaaatagaagtacagtaaatccctaggcttctagctggtgcaaccatccagaacacagctgggaatgtggaagtaagcagaaaagccaaatgatggaaacagctgtcataaagcccatgcattctatgtggagaaaaggccttcagaaatttattatcagcaatcattgaatggctcctgtatccagagcagtatgctgggtgcaggggattccaagaggtgtcaagcaggaatcaagcttttgaggaacttgcattcaaattaggtagatagggtttatacgtgagaagataaaatgctttggttatccagtttcccagtctatggcagattagaagtagcaaatggtattggttgggggccgatgggaatcacaggaagggatcgtgttagaggcaggtaagacttgacatctggaagaagtgagagaggacagttggagggtgaccagaagctgaatgggagagccagaacttgctgatcttggcagtttgagatctcctagaatgggcgaatgctcaaagccacctttgtaaccataatcatcgagggcactagtatatttcattacagtattaaataatggtgtttggcttattctgatttaaaagttcagaaagtacattttagaaagagttccattactgggcacggtggctcacgcctgtaatcccagcactttgggaggccaaggtgggcggatcacctgaggttgggagaccagcctgaccaacatggagaaaccccgtctctactaaaaatgccaaaattagccaggcgtggtggcacatgcttgtaatcccagctactcgggaggctgaggcaggagaattagttgaacccgggaggtggaggttgcagtgagccgagattgagccattgcactctagcttgggcaacaagagtgaaactctgtctcaaaaaaaaaaaaaaaaaaaaagagttctattggaaatattcaaaatatgaaaactacccttaagggggaaatttagttaacttacacatttacctatctagagcacccagtttcccaacagtgctggatcaacaaggagtcaatctacgtgtcactttgtctttttattttaaaaaatgtgttaaaaattgtatattattaattcagtggctttttcacctcagagcttgtggtttatgattttgttcctctgcacctttttttttttttttttgagacagggtctcactcttttgtccaggctggaatgcagtggcatgatctctgctcactgcaacctctgccacccaggttcaagagattatccctcagccttccaagtagctgtgattataggcatgcaccaccacgtccagctaatttgtatatttttagtagagatgggctttcaccatgttggccaggctggtctcgaactcctggccttaagtgattctgccttggcctcccaaagtgctgggacaggcgtgagccaccacgcccggcccctctgcaccttctttttttttttttttttttgaggcagagtcttgctctattgcccaggctggagtgcaatggcgcattctccactcactgcaacctccgcctcccgggttcaagcgattcttctgccttagcttcctgagcagctgagattacaggtgtgccccaccacgcctagctaatttttgtattttttagtagagacggggtttctccatgttggtcatgctggtcttgaactcctgacctcatgatccgcccaccttggcctcccaaagtgctggggttacaggcgtgagccaccacacctggcccctctgcaccttcttttgaaagccctctagaacatctaggttcaacttagtttctgatactgtactacctgctgtggtcagtttagggaactgagttttgacctgaagtcaacaacagttggttcctcgttaagggtgacacatttgaatactggtttcccttgtaaacatttaccaaactaggtaaatgtataatcataagaaacactagaagttaaggatagtgtctgactatgtagctatttgaaccttaaaaaaaagcaaagcttggctgggcatggtggctctcgcctgtaatcccatcactttgggaggtcgaggcaggcagatcacttgaggccaggagttcaagaccagcctggccaacatggtgaaaccccttctcgactaaaaacacaaaaattagctggggtgtggtggtatgcacctgtaatcccagctactcgggaggctgaggcacaaggattgtttgaacttgggaggcagagattgcagcaagccaagatcacaccactacaccccagcttgggcgacagagtgagactctgtcaaaaaaaaaaaaaggcagctctatgtgccctatcatgccagatctgagaaaccatgtatccccagttcctaacatactgcatggcatgtggtaggtgctcaggaacgttaagcatgactttttgtttctgtactcattccaggacgagatatttttattcatatctgctgtgctcttactctattcttctaaaattcatatgttgaaatcctaaccctcaaggtgatggtattaggaggtggagtctctgggaggtaaaccctcatgaatgtgattagtgcccttataaaagaggccccagagaaaaccgttaacacttgcgccacatgaaattacggtgagaagatggccctctatgaggaagcatgcccttaccagaacccaatctaccagcatcttgatcttggacttcctggcctccagaactgcaagcaataaatttctgttgtttagaagccacccaatctttggtattttgttttagcagcccaaacaggctaagataaccctttttaaatctaattattttaagctatctcatttatttttaacttttgcatacattcagtcctagatgcctaagtaaggaaaggaaaaggaaaacatgtttttttaccccttaacctagagcgtggtgctctttcttggcttgcttggaggtgggcgcttagtatttcatgtggtttgttttaatcccggtagacaaatggttgctacttcttacgctgtctgttccagacattagcaggaacttggctgtgcctgcagaggtgctttttctttctttcttttttttttttttttttccttttgagacgtagtttcactcttgttgcccaggctggagtgcaatggcataatctcagctcactgcaacctctgcctcctgggttcaagtgattctcctgccccagcctcctgtgcagctgggactacaggcacccgccaccatgctcggctaattttggtatttttagtagagacgggtttcaccgtgttagccaggctggtctcgaacccctgacctcaggtgatctgcctgcctcggcctcccaaagtgctgggattacaggcatgagcccccacacctggcctcagaggtgcttttagaagaggctacctttgcccctttttgttgcatcagcctttctactaggtgctcacttccgtcttcttctcctggaggtttgggtcaggacttgatctctgcatcatcgcaaccattcttttcatgctagtcctttctttgcaaagccactttgttagtttggcttttgcaggcctcttaaagcctgtcttctttcttctgttcaccttctgcctaccagagcaggctggaagtggtttcttttggactgtagacatttccttagttcaccaaacccttgacgtcatcatcccagcaagcattaagccaccagaatatttttttttccttcagttattgtttctatttcaccacacatttgtctccattgagttttcggtctggtgtttggtcagagatgaaaacaaagcactgtgtccttgcaaactgcagtgtaaagcatgtggttagcagttactacttgcagtggtccagtctgagtgggagtatcatttttcttggcagtgacttcacagaaagtcctgttttttggtgccagagtaagcagtcattacattccttacaatttatagtcaaattattatctactattgtttaaattgccttaattatagaagatttccctgtgctaagattttaaaaagcaaaataagacaactttttaccaatgtactttagaaatggtccttaaacatcacctgtcaccaggatgttggaggctatggtaaggattagttctttgtgtttatggggagattttttttaaaggggagtagtgaaatgagttcactttaaactgaatttgaattaaatgcccccagctggctggttggttaatgttctgccttgttgtttacccacagtttggaactaacttttctttctgccctctcagatctgatgggcctggacacattctgggaggctcttctggtatgaggtcaatggattattaagcagtgaggcagtcttagaagatgttcgtgtattctttaggttggagagcaaatgatgaaataacaaccttccacaataagggactgcatcaattttcttgtaatctgaataaagatttaggtgactggatgggatatgtttcagcttagctaatgtttcataatctctacctttgggctctgctttcaagatatatgtaaaatttgtcatcttaccatctcagtgactactatcctggtctcacccctcattacctcttgcctggattattgcagtcgcccatatcagttcccctgctctagctctctggctctggctctccccagcctgtgttctcagcatagcaaccagtgtgatggtattctcttaaacttagatcgtatcactcctttgctcagaatgctccaatggttccccatgccagctagagtgaaaatcaaggcttatgagcacatctgccttctcctgtgccagcccacgaggtcttctcttctcaggctttatctttatccaggtcccatcccactctagccatgttggtctctctgttttccttcaagcacaccaggcacgttcaggggcctttgcacttcttattttcagtgccttgaacaccctgctgccagatagcagcatggttcactccctcacatgtttcagggctttgattacctatcaccttaatagagaagcttttcctggtctctgtataaaataggatactcccacccccccaccccctgcagacacacacatatattcatatacttcgtccttcttcctctctgctttcttcttcttagttatcaccacctgacctgtgggcaggggctttgcctcttttattcactgccctatacccaatgcctaccacattggctaatactcaaaaatgtttgttgaatgaatacatgaatgagtactccttgcaaataggttgctcttaggaaaaaagctttcagagggcatagttgactctttaggacttgtgaatatgagattatacatatgaactcccatctgtagaaagggggtgcctaaactggattcattcattcagcagatatttagcaagtgcctattaattgctaggcgctggggatagaacagtgaataaaaaggatacaagccaggtctcacacttatggagctcacagtctaaatggtgaggcagacattgattcaataattctgaaaattggtaattagttacagttgtgataactacttccaaggaaaagcccttggtcttggatgtggggtaagggaatggcaatcagggcaaagcatagttttcttgaacattatgggcctataaggccttctcattttctaggagtagtgctttttacatcatcacaagctcccgcccccagtgaatggccagggtttgtgtttctggcagtggatcctgagatgagtcctagagcacttgtgcagtagtgcagggaagataggcccgagttatcttggcttacatggaacactttctctggttgcatattgtgaacaaaagttctctgaaaaggaatttggaggaaaaagacttcattccagtgaacagtttgtaaactggggagacacatccttcagtgtaaaacaaaagtgcacattccagagaccaaagagaggattctggtttctggttgtttttgttttgggacagagtcttgctctgtcgcccaggctggagtgcagtggtgtgatcttggctcactgcagcctctgcctcccaggttcaaacaattctcccaactcagcctcccaagtagctggaactacaggtgcacaccaccactccctgctaatttttgtagagatggggttttgccatgttggccaggctgggctcagactcctggccccaagtgatctgcccaccttgggctcccaaagtgttgggattacaggcgtgagccaccgagcctggctggattctggttttagtgcaaaagttcccacctaggttcctaagcaagtgttatgcaaatgaaagactgaaatttgcttaattccaattggttgactcagctgggccctgattggttgatacaagtgagccctgattggttggtacaggtgagctctgattggttgcttcaggggagttctgaaagtcccaaagttaaacggaggtgggtgttttcaggaaactcagaggaagtatgtcacctttagctagcaaatgaccacttgattctattttaaatttaggcctagttaaccacttgggatccaccttgaaggattggctctttcaggttcacatttgtttacaatactgtggccatcattttaaggattgggtttacaggggcactggaaaatgcaaagttaacgcttgtgtcactttgcactgttgttttctgtcctctaggtggtctgcaaaggtaccagacaattagtgctaaagcctttaggcttttatgaaaggtctgagtccgctctcattttcatagagaccacagaaatactgtcatttgattggtgggtggctcaagatgaagccccctggccttgcaatagtaaaactctggtttagcaaaatatggatggaatgcatctgtcaattggtgacaagattccttcccttgccaagcctttatcaatggtgaccgagtgggcaggttgtctcaaggagaggagggtcctggctgtgcagggagcaagtgcataggctggccagggagattaggattgtaagcaaatgcagcctgagtgataagtcttagcagttatcaaaacaggatgggaaggagccttccttgccacatgctgctgctctgagaacagagtcttccgtatttcaagaaagattgttttttcagaattttagatgaacactgtgagataggtccctatttcttttttttttttttctctgagacagagtctcagtctgtcacccaggctaaagtgcagtggcacaatcttgtctcactgcaacttccacctcccgggttcaagtgattctcctgcctcagcctcccgagtaactgggattacaggtgcttgccaccacacctggctaattttgtatttttagtagaggaagggttttaccatgttggccaggctggtcttgaactcctgacctcaggtgaactcacccgcttcaacctcccaaaatgctgggattacaggcgtgagccacggggcctggccagtagatccctatttcttagtttgttcagaaattcaaagtcctaatgaggaaccctgaggctggggtatgtatagagacactagctcggatgcctgacaattttacctagaggtacatgagtagctgtgacatcccagtgtttctgggttacaagcaagtatttttagctattttctaatgtggacccctcttctgaagggcatactacatagccatgacaaaggctgaagtcccaagctctccatttaatgcagtgaactgactgcattgttgtaaattgggagcaagtttgtaggcaaggggcaagtttgcttaaatatgaagactaaggtgagccctactttaaatatgaatttaaatatgaagattatggtatatgccctattttaaatagtataggcttactatattttgtttgtttgagaccgagtctctctctgtcacccaggctggagtgcgatggggcaatctcagctcacagcagcttgtgcatcctgggttcaagtgattctcctgcctcagcctcccaagtagctgggattacaggtgtgagccaccaccacgcccagctaatttttggatttttagtagagacagggattcaccatgttgctcaggctggtctcgaactcctgagctcaggtgatctgcccgccttggcctcccaaagtgctgggattacaggcgtgagccactgtgcccagcctcagcctactattattataagggtaagttttctgattaagaatataagtgtttaatttctcttacaatggctctaatgatccatatgctaggaggcactcagggtgtgggctgagctgcatgagcttatgatagggcaaaccaatctttatctaaacttagctttaagtttatgggtatgtgattgtctctgctttatttttatttttacttttttttttttgagacaaggtcttactctgtcacccaccctggagggcagtggtgtgatcacggctcactgcagcctcaacctcccagccttagatgatcctcccacctcaccctcccaagtagctgagatcacaagcacacaccaccatgcctggctaattatatattttttgtaggagggagttttgccatatcgcccaggccagtctcgaactcccagcgcaagtgatctgcctgcctcggcttcccaaagcgctgggactagaggcgtgtgccaccacacctggctaatttctgtattttttgtagagatggggttttgccatgttgcccaggctggtctcgagcttctgggctcaagtgatctgcctgccttggcctcccaaagtgctgggattacaggtgtgagctgctgtgcccggcctctgctttagtttagaaacagataaagcatttgccatttttttaccagtaatcttttagtgtttctcttggagtgctgagattttcttggttgcttctaagctcaagagtgaagtaatatacaatgagattctggggataagcatgcttctctctctgctgggtctgtaatgaaaggtttgttaagcaaataaatggtgtaaatattatatcaggaaatgattaacacctacatagggaaagagactattcccaaacacctcaggaacaaccattgtaatcaaaaccattgtgttaattacaaaaatatctgtttattaaagtaggtctttaagttgctttagttgccaatacttcctgcggtcactttgtgtttgaaagtgataagttcgtgtttctttaaaaatactgtataattcagcccatattccctccaataagtcaaatttatagaagacatttctgtaatcgaccatattaacgagagactaatggcaactcggctgttaggacaggatatttgtttttcttcttgaagtcctagcagctgttttatcctcatattttgcagaaaggaaaaacaactaaaaaaatgagatgtgtttttaatgtgaggggaatgcaagctgatcactaagaataaagagaaatgattgcatttggcgcagttattgatttcagaaatgtctttgaatcatgttatatgcatgagtgttatgccaatgctttgtggcttcctggggtgacatttagggaatgtagatttagatcctacattttgccaaatataaattgcctcaagtattaagtcgttttctgaacaaaaattgatggtaaaggaatttatcgctattttcaacagttactagatgtgtgatcagagagttgtgtcaaaccttgaatttttctaatgttgtatatttagtagtgtatgctgttgttgaaagtataacctcaactgcaggcagtttcctagggaccattaatttgttcttaaagtatttcagtcgtgatagtcattttcttttgaaatgaaggaaaattttgatcattaagaaagaataacagcattttacactaaataaatgtaaagtattggagatttcttctaataccatataacttaggtttcttagttatattgaattctgtccactgaagcaattgactttgtgccagtgttccttttcaaacaatttattataaacttgacctgtcctttctcatctcatatctctcttcttttcctaatatttgttttcttttaatcagtcaatattgattttttttcattaagaacataaggggctaacatgatttcatcagcccgctaattgctttagtaatagaaatctgttggtccctcaaacatcaggggtgcagttttaaaaagaagtggtaactgattcttgaaccatatgtctttaatttttacaaaaagtctagcagggcctgaaactttaaaaaaattcgtaccattctcttccaaggtttaaaaaaaatttcatttttttatttttgagatggagtctcactctgttgcccaggctggagtgcagtggcatgatcttggctcattgcaacctctgcctccagggttcaagcaattctcctgcctcagcctcccaagtagctgggattacaggcatgcaccaccatacctggctaattttgtatttttttagtagagacagggtttcaccgtgttggtcaggctggtcttgaactcctcacctcaggtaatacacccaccttggcctcccaaaatgctgagattacaggcgtgagccaccatgcctggccataaatttttaattataatataaaccctatctacttaaaattatttgatcatattcaataggattcgtacaatcatggtgataattgttattaattattaatttaataacaataggtaacaactactgagcactcactatgggcctattttgaacgcatcatgtagattaacccatttaatgtaaacagaaaataaaaaagatggaggatggagtggagaattttaaatggagtaaagaattttgaaaggctattacagtgaatgaactgtgggcttgcgggtagctgggggtaaaataggaacaccaactggttatgcattttttgtttatctgataaaaagaaacatgagagctcttcaggcaaggtattttcttgttgttgctcaatctagaaagaatgtattatggaggctgttacgtaaatgacactaaacagcttaataatcagtgttgtcaacataatttcacatggctgtttcttctactgatcttccaatagaagatcaaccaaaacaacaggtgagaaagtcaggattttaggtccatggtgttgtcttgggtctttagactaaagaatcaaactcttcctgtctttagtggtaactgcttctttcttgtgtatgagttcatatctcttagtctctgagtcagggttctcctgatgagtagctaccaacaccatgatgacaataataaatacagccacctccagtggccagaaacctggaaaaagttgcacactggggaagcaagaacctgtgtactgaagccactttagaacttggaagtgaaataattggggtgagctggacagcatcttctcttcttcttcagcccctcttttctccttgccctgatcaactctgctctcaggactttgtacctggcactgagagttgtcatactgtcataagacctccagagattatggtttatcataggataaatgttttccagttgaagagatgatagaataacagtagtgataagagtaacttaggtatgttttacatatcacgatccagtcttattcacctgcatatatacatatatatatatatttttttttgagacagaatcttgctctgtcacccaggctggagtgaagtggcgcagtctcggctcactgcaacctccacctcccgattcaagcgattctcctgcctcagcctcccatgtatgtgggattaaaggcacccgctaccatgcctgactaatttttgtatttttagtagagacagggtttcaccatgttggccaggctggtctccaactcctgacctcaagttatctgcccaccttggcctccctaagtgctgggattacaggtgtgagcctctgtgcccggtgtgcatatgtttttatatggcttaaattgtggtatgtattactgggtgtatctcctgtttttaatataacaactgtaaaaatgcttttgtggttttatacagttaaaaattgcaaatgactgaataatattcccttaagttaatgtactgtaatctattatatgtaccacaaatggatatttagattatttttggtgttttgaatgtgtgtttttttgtgtttggttttatattcgaatacagcaatgatcattcctgtgtgtttggcttctgttgaataacttccttaagttcaattttatgatacatttctttttttttctttctttcagaaggttgaaaggaaggaaactttacccttatgcctaaagtctagtctaacatcagcacatgccaaattcctctgcttacaggtgtgtaggggagggaaggaaatacgaagttgaacccagggcattagttctgagagttcaggttttgttttttttttttttctctctctaagcacttcccaaattcaccctttttcttagttctggccaggaacctgcatctactctggtttttaaaaacctagttcagcaacattcccagaaacagctaaactgttggctggtgggagagtgggttaaacctgaactacaaattagttgcttgaagggtagtgccttttcttgtggttcttctgtccttttgattggaagagggtttcccacatgtctgtgtgtctcacttttaaaaataaaacaaaggaaagaaaccccaaacaaaacccttcctaaaacatttgtcatctgaacagaacttcctagaaagcagtgtcattgtttctaaaaggaggagctcgtaataaccctccattctccctcctctcccacttttttacaatgaaatgattctatgactattagttgtgaaatggcttaattcagtttcttattctttattgaaaataactttgctatgcctagtgtctgtctctggtcaaagggcgtttcctgtgtcattggcttccacggtttgtctgctttcagctttgtgatccggagggtacagtctcgccttttaaattgtctgcctcatcttttatctttcaacgggtcctggaaagaaatcatccaacggcttctttccagtgtcagtttttgaaagatccatggcttgctttattttgacaggtggttggtgaaagaggtgctcaaagggtggggtaaaggaggagggctatataagcggaaggagaggaaagagtttagccgcttcttttggggctgtctgacaaatggcaagtgattattatgctctccttttttttttttttttgttttgtttttgaaaaggagtttgccaataaagcctgaagttgggtgacagctgtatcctttttaggaccatttctatgtctttctttaccttaaaaggctggggcatccccaatggaaacacaattgggacatacaagatgcagctgtatagattaatttcctgtaatgaacaagagtgataagtcattgaaaagctaggtgtccttatcagtaggagctgtctcattggataagccacagggtccacgccagtgtggttatctcagatggtcccagggtgttcagggatatctcccagtagccctgatttgctttagccatgctttctttagtttatcccacctctaggaataacagattgactgttgactggctactagatataagatagtgcctctctttattgtacgttaatatttatttatttattttgagacagaatcttgctctgtctcccaggctggagtgtagtggtgcaatctcggctcactgcagcctttgcctcccgggtttaagcaattctcatgccttagcctcctgagtaactgggattacaggcatgcaccaccacgcccagctaatgtttgtatttttagtagagacggggtttcaccatgttgcccaggctggtctcgaactcctgacctcaggtgatccaccagccttggcctcccaaagtgctgggattacaggcatgagccaccatgctggacctattgtaagtgaatacaactcctcacctcttctaacctttggtagcttccctagattgtcgtttgtagagttaatgggcctttattatgccacaggagtgagaatgatgaatgtttccctttaagtcttctttctgtaccagactctcctcacttcttatcccaccctttccctgactctgcaataacgtcagctgccctcagctgagccctcagttcagcttatatcttgcttgatgtgcacagcccagaattatacaataatgttccaggtgctttgcagaaaggtagtagaatgtattcttttctgattcccatgccctccttgtgttcacgaagcaatttttttgggtattgttgactgcagtacatttaacagattaaagcctgttaataattaagaacaatatgtaaggtccaaatcgatttacaaaattaaccagcagaaaaccacagaagctccaacaatacagaactaaaaggatttgggatccaggccattcttttccagaccttctcttcttgttctatcccagtcctggtttacaagtggcctcttgggaggaaaggaagcgatcagtaagggtggaaaccaggagcaaaaagcagcccacattgcctttttgtactagaactgttgttaacaaagactgcttggaaagagggccatctgctgaggcagagaaagctttctgttatgaagggatgtttgttgcatggccttttagggattcactgtaacttagagccctcattagggaaggtgtctcaaactcataagcgtaggcagatgataacaacaacagcaataatcaaaatttgattcgggatgggtttctagaaacttgacagtatacatagcttttaattccttttactgaccttttcagaagttctaaaatattttctttccggtctgatgttatcaaatttcaatatttacactagactgtaggctgatttcttttttcctattctaagtggacacagctataacatgagcacataaacatcactgccaggcgggagaaagagcctttggggatcaggaagcctggatgctagtccctgccttgctgctgaccagctgggggatgggcattcagcaagtgagcacatcaaggtcttgttcccggtgttcatgaaaggagggcgttaaacttgattatattactaggatcctttccagctataatagtctgtgtttcactgcaaatgcgttgagagctgatgagatgatctggaaagataaggggaataagaggaaagctctttcctcattgcatatgtattcttgaatataataaaaccttgaaatgagcagttctgggtaactgagctttctgaatggtttttgtctccttccttgctgtcagctgtcattctgtactgctgttagcttgctcgcttttagcaactcctgtccctccttggaaacttcccttgtgctctttggaactatagcgttaagctcatcaaaactctatgccaagtcagtatacataaagctgtgaggggagggcttctcctatggctgtggtgcatggatttttggctgatgaaaccctttgggggcttatatttaggttccagataggtaatgtgttactatgttcccatttgtcttaggctagacattagttaatacgctaattcattatgaaagatgagtaggtgggtgagaggaggaaagggaggcaagttatgtgtacatcagaagagacctcattttagaaaagatcaaaaaaagcagtttgaggtgaagaagtaggctgtggagcttttttgagacagctggagttcgaccggtagcttagatcataacgagaacgctggcttgggtgtgcctctctcacttcaagcttctctgcttgaagttgcgcactgggaagaacatgctgcctcagccagtgcctggaatgttgtgcatgaacttctgaaagactggagaccctcctccccttatgtgagtgcatagtcgctgagtgtgaatttgaacccagcagttcttccttcagaaggttaaatgtcaaggcattaacattcagataagtcgtcttactcaaaatttgctttaggatgctcctgcccgaaatctaacacccatgagtgctcattatgttcagaagagtctttcaggctatcaggtccaacagcagtatgtacccacggtccgtggtgctggccacatgtatatttcatggtcacaacagagtcatcttgggtagagaccctgggtaatttccatcccatctttctacctttcccaatttgatgtccccctcttcccactccctgtactctacatatagtgaaaccagatgagctgtttccccaaaacagccgggactgtcttctcgtctcgcccgcaggcctttatacacgtgttcttcctttagcctaaattttgccctccctaattctgctgattaacagtccttctcatctcttgtagatctttgcatctgttttctcagatgcccatctggaaattgcttttgacccatagcattttgccatgaatgaatgaatggacattagaatgatgaattgttcattcatttattctgtaagcatttatcaaatatctcctgtgtgcccagctaggtgtcagttattagggatataagagagagtaagacagacgcagttccagtcttcaaggcaatattctaccttatattaaaattggcagctgggtgtggtggttcatgcctgtaatcccagcagtttggaaggctgaagtgggtggatcacttgaattcaggagttcgagaccagcctgggcaacatcatgaaaccctgtctctactgagaatacaaaaaaattggctgggtatagtggcgcacgcctgtagttccaggtattcaggaggctgaggtgggaggatggcttcagcccaggagatggaggtggcagtgagctcagattgtgccactgcacttcagtctgggtgacagactcgtaccctgtctcaaaaaaaaaaaaaaaaaaaaaaggctatgggtagctgtgctggtgctgaggcagaaggatcacttgagcccaggagtttggggttatagtgtgctagtattgtgcctttgaatagccactgcactccagcctgagcaacatagtgagagtccatctcttaaaaagagttggctggctgggcgcggtggctcatgcctgtaatcccagcactttgggaggccgaggcaggtggatcacgaggtcaggagatggagatcaagaccatcctggctaacacggtgataccccgtctctactaaaaatacaaaaacttagccaggcatagtggtgggcacctgtgtgaacccaagaggcggagcttgccgtgagccgagatcataccactgcactccagcctgggcaacagagcaagactccgtttcaaaaaaaaaaaaaggagttggctgttggttttattacttctacagggatgtaagctccttgaagccgtcaggcattatatcttgttcagctttataatcccctatcatgccttacatatagtacaggggctcagtaagtgttactaactcagtttggaaaatgcccagtttcctttccgttaagaaaagtcatacatgtccagaagcctattccaaggcatcatctttgttgtagcactttgatataacaacagtggttatgttaggctttgaagcacatttttccctcaacatcaagtggactaaaaacacagaaggttaagaccggtcactgacaggtacgtaaagggtcttttcaccgtgaagcttttaaagtaagggctttgcccatttgtggtcccaggtaggtgtatattctagcctgccacctaccttatggccagcattgctaaagtccctttagcaacaaatctgtgtatctatctattgaaaagatttgttgtcatctatggcatagaagagccttgcagaatacttgtcccataaggcttttagacaacacaaagttgtgggaaaaacagttcctgatccacctagttttgagcttaagtcttaacatgaaaataatatagctagggatgatttactctgagctggatggatacttaatgttagaaactgaagaagctattggggaactcaattcaagcatttgagccctatcggtgctgcactagagttaggaaaataaaaagctatgacctcagaagtccaatgtaccatgtaattaataatcaacaaacatttcgaagtatgattatgaaatgaaatctagcgctcatttacaggaaacactgcctctattacaaatgatagacttattgggtttatctggcattgcctgtcctttaagtcctatataattattcctaaacctttcaggaaagaatttgagcataatatcttaaactcataagctataattcactaacaaggttgaaatgaaaatctcatttagttttctgtgcacttttccttctttttttctccttccttctttcctttttttctgttttcttcttttttcttttcttttctctctctctcttcttttcttcctttttctgtcattgcttttctttggtgaaatgcttccaattctctactgtttacattctggcagacaactataaataagaaggaattaatatccctgcaaaatgctttgggacattattcgcagcatataattgaaacccactgttttctttcatgcagcattactacaataacaggaaatactgggagaccaaagtagagcctctcagcccaccctaaggatatctgtaggcctttgtccataaagccactttgctcttgtgaactgaggctgatatgctatagccaagtaagatttagtggatgtatgtgaaaacaggatcctgtcggggtacagttgaatcccatgtcagcacaggttgaaacagccagcttgctagcggtgtaggtattcctttttttatgtagtgaagattccaacttcttctgacaccagcatgtcaggtcgcatgaaacttcctgattcaacactcagagggagggactatgggcttctggctgcctcctccttcaagtattaagacagaaccttccctctaatgaccatgagaattagcttggtgtccaaaagcattgggtggattagcatgtgggttattttttcccaaaatctaattctgcataaaattggcttttgtctcaaaaccataaactaaagggattagaaactgggggtggggtagtagtctttgtactcagagaatagatacttttagttcaagtatgtcagagcgaattaggactattaatgctctaacaaaactgctagttattgagatggtccttaaaacaagggaggccagggggcatctgaatagacagatttctgacttaatagccatgtctcaggttgttctttagtctccgagaatatgcacctgcctcccatttccattaatgtcattaggagctgcatattgtatataatacagggtcatcagggtctttattgctgttctttgaaacagaataaaatcatgtccctttcattctatctgaaacattttgtattaaaattaagatcccttaggctttgcccaattacttttcagataaagtttcctgataatgtgcctagagcagttttaatttaaacaagcaaatatgtattctttgtttaaacattttcctattccatttgtgtccctggtagaatcatctgaaagaactgcttagaatctttttttttttttttttttgagacagggtctctttctgtcacccaggctggactgcagtggtacaatcatagctcactgcaaccttgacctccttggctcaagcgatcctcccacctcagtctcccaaagtgctgagattacaggcatgaaccactgtgctgggccagagtttttttaaattttatttttattttttatttattttatttatttttattttttgagttaaaatggactccagtgcttactgttaaagctatttaaaagccccctcctccctaggcccccacataggaaagttgctgcacagaaaacaaatatcagcaaagcctcgatcccagtcctgtccccttgcctagctggtattttggggctgtcctttcattttagcattagcctaataatatgtacacatgtataatacacccacaaatcaaacgttagttttggctgcctcactgttggggtggtgatgtgggaaaggaataaaagctcagcaattagatgacttgcattttaactagtattggaatgcctgttctgggttaagcttggggccaggaactttaagtacttaattttgatgaatctgttattaacttcacaagcatctcagagaggagtatttttatcttcattattctgatcagaaactgaacctaagtttctgtaactgtaaaataggataatgccttcaagagttatggtgcagacaaaataaaatgataatatacgtgaagatgctttaagcaccatatgtatgtgaggcattgccattattatgacaattacttctattctgatgataaatactttcaagtaaaaatcaaaagcaaattagccagactttttgactgttcccgatgtttaacaactgaattcttcggtgtttcttacatttcttctaagaccatgtagatcatgaacacttttatgctcttttccccatgtcccccaacctgacaacccataaaaattgccttgaagagtatatggcttgcaaatgtcactgcaagtcaccctgtttgcaatcccaagcaatactgagtccttgaactgaatgctctacaacaaatcaaaaagaatgccttcctgtgagatagaggctgtgttgtacttaaatatacttactttattcactcacagctggaaaggtgcaggacagtgataacgaggtaatcctagactcttggggacatcagttagttacctgtattaagatgcattttaatatttttgtacaaacagatgtgagttcattatgagtcctgatttagggttctctggctgtgacctgaggcctgtggaagtttcagagggcttctgcagagatcccaaaaggcagtgctttcctgctgggttagagactatgcagagagagtgtttaaacagagtccagcttgacagctagcacagatactctttctgttgtgttgggagccagtggtaggtcagaaaagggaacactggctattaagagatttgcaggaggcgtaagggaagggtttgcctgagatctgactgtcttggtagcttctcagcactcctttttacccttgaggtctttgatgacacccttgggaaatgatgcccgacctgggacctttcatggttcctgcttgtacctgtcacgctatagcccggggcctgagccttctggagccttccagaaatgcttcacagaaatgctccacatgtaccaggacaatgctcagagtctgcttttggattgggctctcactcctactcaggtaattgtgcatccttacgtaacctttcaaaccgaagactgagacatttatagcaaccctaaagttcctctcatctcctctttcctctttcaaagtttgaactttgagattctcaggggaaacaacttttttttttttaagaaatgactttaattcactgcaggttttaacaacagggtatggccactctcctgttttcatctgaaggaaatggctttgtttgacagagatccttaaaacttattaacttttgaaaaatcaatagcactattccttccaggaaaaaagaaaaagaaaaaggctgtatggctcctttttacaaaggagttaaaattgtcagaatttgttaggccttttacatttttatcttgcgcatagccatttgctctgggtagtggggattgtctagttcatttggacacattaaagtgtatgtctctgtgcatttccagttccctgaagaaaattctcgagttgtattgttacaatagtacagagagttttcatgtaccttctaccccaacacatgcatagcctcccccgtgattaccattccccaccacagtggtgcatttgttacagtcagtgaacctacattgactcatcatcatcacccaaagtctgtaagtttacagtagggttcactcattgttttttgagatagtcttgctttgccccttaggctggagtgcagtggtgtgatcttggctcactgcaaccttagcctcccgggctcaagcaattcttctgcctcagcctcctgagtagctggaattacaggcatgcaccacaacacctggctagtttttaaaatatttttagtagagacggggtttccatgttgcccaggctagtctcgatctcctggcctcaagagatccgcctgcctccacctcccaaagtgctgggattacaggtgtgagcccatgtgtccaggcaacagtagggttcactcttgatgttgtatattctgtaggcttggacaaacatatagtgacatgcatccatcattattgtatcagacagggtagtttcactgccctaaaattcctctgtgctccacctattcatcccttccttccatcaactcctggcaaccactcatctttttgactgtctctatagttatgtcctttccagaatgtcatatagttggaatctgtatgacattccatatgtcatatagttggaaacagtacgtagccttttcagattgacttctttcacttaataatatgcatttaaggtttctttatgtcttttcttggcttgatagttcatttcattttagtaccaaaattctcttgtctggatgaaccacagattcacctactgaaggacatcttagttgcttccaagttttggcaaattttggcaattaggaataagctgctataaacatctgtgtgcaaggttttgtgtgaatatgttttcagctcatttgaataaataccaaggagagtagttgctagatcatatgataagggtgtgtttagttttgttagaaactgccaaactgccttcaaatggctgtaccatgttacattcccaccaacaatgagagtttctcttgcgctataaccttgccagcatttggagttgtgagataccattacatgcctcactgttgttttcatttgcaattccctaatgacatatgatgttgaacatattttcacatgcttatttaccatgtatatatcttcagtgacgagttcgctgagaccttttgcctgtttttttgtttgtttgtttgtttgtttgtttttgagacggagtctcgctctgtctgtcgcccaggctggagtgcagtggcgcgatctcagctcactgcaagctccacctcctgggttcacgccattctcctgcctcagcctcccaagtagctgggactacaggtgcccgccaccacgcctggctaatttttttgtatttttagtagagacggggtttcaccgtgttagccaggatggtcttgatctcctgacctggtgatccacccgccttggcctcccaaagtgctgcaattacaggcgtgagccactgtgcccggccttttttttttttttttttttttgagacggagtctcctctgtcacacaggctggagtgcagtggcacgatcttagctcactgcaagctccacctcctgggttcacgccattctcctgcctcagcctcccaagtagctgggactacaggcgcccaccaccacgcccagctattttgtattttttagtagaaacaaggtttcaccatgttagccaggatggtctcgatctcctgacctcgtgatccacctgccttggcctcccaaagtgctgggaatacaagcatgagccaccgcacccgacccaccttttgcctgttttgtaatcaagttgttttcttatgatcttaatactttttcatcctatgacaagtgttaatttggttagctggacattttggttttgattacatattccatttagatatgtagggcttaagtcagattatgccaggtatatgttcccttgggcttgctgaaggattcacttttattaacttgattctggtgaaagggcgtgtaaaaagtgagactgatcaactaaatgtgccatttaacccactgaatgcacaaaccttgcaggaaagtatagtcagttcactataacacaacatagtcatttctaaaaatcaccatgctatgccaaattgtgtggtaagacaacagtaggcgttatgggaaaattggggttagggcacaacactaacaaacttatccactgacacattaaaaaagtaaaaaggaaccaaagaaacttaggagcacagtttcacacatgctaaatggttaagaaatacacaaatattgccatacatatggcatgtgaccttgaagacatctgaagtttaactgtggacagggaagtcagaagggttccagcttgtgtgagttattatgaagtggtggatggagagttatctgaaatctgatggaaagctgtagcactaactgtggagataggggtggctcataccactggactgagggagctggtggatgtttaatatatgtgttttgcgtatttctacatggctgggtacagctggttgcggtttcctgcattcacctcctatttctggaagacaagctcacgcataaggaaacgtgaaattttcattatgctcaacttcttccttaatatatcaattgcattgaaacaaattcacattttcaaaataaatgtgatagcataatagactgtaactaatatcctttgttgcattcttgagcatatgttcctttcatcctcatagtagctgctcacgtatgatctcctttgtatgtgctgcccagaagtgttggtatctggggcccactgaccccggttcttttatcacctgtccattttttctaccatgtgcctcttgtgctgcttaggagggccagttagtatgcaaagagtagacttctggttctatgttgagggaggagtgcagggctggtaagagctattgcttactaaaaattgctggtgtggatgaggcatccgccagggctgagctctagaaggattatctggagcttgtctaactagggctcactgcatatttgagccctcgaatggactgtcttcataaagtaattaaaagcatattggaagcacatcttctttctaatctctggcattggatcttagcaggactgtattcagttgtgtctacatctgttttgtgtgcaatttgcctctcacggattatggaaaccatctcttgctggggaagctttcagtcgtgttaaagactcatttaccaagggaaaacaacaccttagaaaggaatttattttcaaaaatagacatccacattgcatataaatgtatatagataagtgtttcaacaacaacaacaaaatgctgcccttctgttccaggaaataaataccttatattcagtttggcgggagggattcttctcaaactaaaactgttctcctctatgtatatcatttcctgtaattccctcactaaagacgctttggattcagaggggctatattattcttggaaagttttggagttttccaaagattgactgagatagatccttagccttacaacttcttgccatccaggaactgcatcacttttttggggggtgggggtgggggtggtgcgggcagacagagtcttgatctgtcgcccaggctggagtgcagtgatgcgatctcggctcactgcaacctccgcctcctgggttcaagtgattctcccacctcagcctcccgagtagctgggattacaggcacccaccaccacgcttggctaatatttgtacctttaatagagatggggttttgccgtcttagccaggctggtctcaaactcctggcctcaaatgatcctcccaccttggcctcccaaagtgctgggattacaggtgtgagccaccacgcccggcccacatcacatgtataagactccactgcttgattaggaatgggaccttggagttaggatctggcactttcgaagtttttgtaaagaaaattcaggactcctcagtctccaggtcaacgaagtccagttttcatgttattctgttattgtttgctatttaggattgctgtagtctacagagatgtaactgtttgaggtggaaaatagaacatatggtatttttgcctagagagcgagggcagtggtttttattcttggctgaccaattgtttctctttcttaagcactttctatgtgccagcattgtgatttttatgggttatctcctttaatcctcacaaaaccctgtaaaatgacccctccctcactttccatataatggaactaagacttctctaagtcacttgcacaggatcagtcagcatggatttgaacccagatctttcatttttaaacgatttcattttttttgttgaaactcacataacataaaattcaccatttcaaccaacttaaagtatcagtggcatttagtatataaacagtgtcatccaaccattaagactatctagttctagaacattttcgtgacttcaaaagtaaaattctgtacccattaagacaccacttctcattcctgcctccccccagcccctggcaaccactaatctgctttcagtctctctggatttgctcattctagacatttcatataaatggaatcatacaatatatgacttttgtgtctagtttctttcacttagcgtaatctactggcactttattcccttcatggtggctgaagaatattgcactgtatggacacaccataatttcattatccattcatcagttgatgggtgcttaggttgcttctgccttttggctatggtgaatagtgctgctgtgaatgtttgtatacagctttgtatgtgaacacctgttttcagttttcttagattggaattattgggccatatggtaattctgtgttttaccttttgaggaaatgccaaagcattttccatggtggcaactacagtttacattcccaccagcagtgtatgaagtgaacccacgtctttctgactccaaagtctgtgctcattttcttaggccatgccatctcctcattacttctcaagggccctagcaattgcctgccaagccacacctccagccaacaacagaagcatgctgcagggtgtctcatgttgtgaggggatggtgttggtaatagggctttttggcttggtgaaagaacatgtgtcagagatttgtcagtggacaacctcctcttcctctgtgtcaggtaatagttaagagtatgggctctggaaccacattttatatgattccaattctttgaaatgtccagcataaggaaatccataggcagtaggatcagtggctgtctaaaatttagggagtgatggttaagttatgggatttctttttttttttttttcttttttttttttgaaatggagtctcgcactgtcgcccaggctggagtgcagtggtgtgatctctgctcactgcaagctccacctccagggttcacaccattctcctgcctcagcctcccgagtagagtagctgggactacaggcacccgccaccacgcccagctagttttttttgtatttttttagtagagatggggtttcaccgtgttagccaggatggtcttgatctcctgacctcgtgatccacccacctcggcctctcaaagtgctgggattacaggcatcaaccaccgtgcccggcccccgggatttctttttagtgtaataaaaatgttctattaacgcttgtggtgatggctgaagagatggttcaactttgaatacactaaaaaccattgcatgggctgggcatgatggctcatgcctgtaatcccagtattttgggaggccaaggtgggcagatcacttgagcccaggagtttgagaccagcatgggcaatgtgacaaaaccctgtctctacaaaaattagctgggtgtggtggtgcacacctgtagtcccagctactctggaagctgaggtcggagggtcgcgtgaacccgggaggttaaagctgcggtgagccatggtcacaccactgcactccagccagggtgacagagcgagagcctgaatcaaaagcaaaaaaaaaaaaaaaaagaaaaaaaaaaagaaaaagaaaagtatggtatactttaaacagatgaattgtatggtatgtgaattatatctcatgaaagaattttttaaagtgtagtctctagagcctcactgccacttattagctctgaacttggacaggttccttagtgactctgttccaggattcatgtttaaagggggggaggataagataatagttctgtacctacctcattgagttgtgaagatcaaaggagctaatatagataatatagtgcttggcatggtgcctgacacataacaaatgctcaatgcatgttgttaactattaatataagcatcataaaatatttttttgaagttccaactgatggatggtgttcatgatagggcagcaaagactggaaacacatagcattcctcttaaaatttaaattctttgttcaaccctgctgccaagggaaatgagcactataggacaatgtaatgggacaataatttgggtagtactgggagatgaggtcatatgggagtgggtgttgggtacacttaagggctgaaaaaagaactggtgctgttgcatgtgaggaaattgtattaaaaaggctgctctaccctcactgacaacagatgttgggaggtcttaggctctgggctccagggcctctgacccccttgaaattctctccaggttctttggaggtcatgatcccacagttggcagagccctggtgtagattagcttccttggatatgttttcctctctctttccctaatgcctcccatcccgagggtctcgaggaactagagggaggtgcttatgctagtaaagaaactagcaccttttcaaggaaaatgaaggaaaaagctgggacagtagggaaggcaggagtctgacccatggatctaggagtggaaaaagaagaacaaaacaccaagctgttctgcttgtccagttgctctgaggttgaaggccttccaggagaagcgtcctcactgttgtctgtgtccatgtttgcaggccacagacattgactatctgcccggtgcctccttgtcaatgtcccatgtgggggagagacaaaagcaaagacagccagccttcccagttccttcaggagacagaacccgaaagccaacacatgaaggcatggaagaacacttccagagaaccagctcacaagtgcaaggggatggggctgtcgaccccgtgtgtatagtgccaaggcaatccaggtcatggttgcagagtgctttactgccatttttattgcctcctttcaataaaccactgcagtgcatgaactggttgtgttttatagctaggaaaactctgagctaccaacacattaagttacttgacactgagagaaccctcaacatgaatgtcttatatctgcaaggatatttgtgttagattccatcatggaggtaggaatgcttatatcagacaaagatgcatatgcacacatgcacacacaagcacacatatgcatgcacacatgccaggggataatgatgtcagatatggggacttaattgctggaagcgagtgtaaaatgccattggtgagggctgggggacagagagagcagccctgtggccctgggtggcaggggagagcccggggtaggttgtgtgcctccctccccaacatacacagtgcccttctcagcctgctgtctgtccattagctgcacggctgctggcctgagcacacgggctcttcttggctttgagccagtggcgagctgggagcctgtgactttgagacttggcccttttcagttttctttgttcagaaaaaagtttcatcctggctgtcttcagtggctgccgaggattaggagaaccctggggagacttggctataggacggctctcaaagctgtgctgggaaatttgaagagggcccatttctctctgtcttatttcaagttacattcttctctcccttcctaaacgagtttttactgttgcaaaccctactgcataatcccctagtgtacttttgtgattctgctgctatggaagggattagaccagtatcaggaccagtaacatattttaaggactgttgaaatggacagtatgaagtaaggttcaaatttggatactcattttaaatagttgcacaagttagaggcaccacatgctttcctgggttagcatttgtcattcttaaaaaaagaaaaagtatgcttttcagtggctggaaagaaaaagaaaggaggaggcttggctcctctgagcagagcatgagaattggatttctaaatggccagagactatggtattcccaagtacaagtggtttgttttcaaaaatttgtaactacttgcagttttgcttgtttaatattgttaagaaatggaaattgcctcagttgtaaagtggttttcccattaaggattttttctttttagttttgatggtttttaccttttaaaaatagtatttatttcatgattatgaacaaattgtttttgcaaatctgattgtattacagtagataggtagatgtttgcatttttcataagctacccattagtgtaaatgtacaaaaaaatgcctttatacatctttttaccatgtttcttgtggtacttggggaggacttaactctgaactgcctccattagcattgtttcccagaggacacattaacagatcaaaaagctatagactactacatatacacataccaggagtacgtagttcagtttctgtaatcccacagtacgcaaatgttggcagaatttcaatgattgtattaatcctgtgagatactttgtcatgcatgatagatgatatttacaaattgaggtctgaaatggtcagaagctttgaagatgctttattgtgcagtatgtggaagtggaagtgtttatattgttttagaccatattggccaaccaggcagcaaaaaatatacagtctcataatagagtacaacaatttcataacaaacctgaaggttgctggggagtttttccagcctaaaccaacaaggttcatcaaaagttttgccaaggtcttaaaaccctatggataattggagcgtttggatatctcatgtgaaacacaaatccatttaaatgccatccacatacctgtgaaatgactttcttaatacatttctgtattgtagactcagagcagaatatgatagccctgctatgaggagctcctggttctttaagggctccacttgattaatcagagaggatctgagcataattaagaatcacattgtatttgaagactgggaagtgggagcccaagaagggtcactgattttttctcaaggtcatacagtcagatcaactcacgaggtcttgtttcctctctacatgtataacagactgtaggttgcttttgcccctttcacccccaactcctgcgatttaacacttttaaattttgaaaggtttccttacttaaagaagttcttggttcaccctggccctactctttgtgactttgcacatttcctttctctttccctacctaccttccacctttagtctgttcctcccactgggcttctcccttcctattcctttaatttttgctgcccttctctaaaacttttcttcatagtgttcatgagtttgagaatagcacatgtcactctaggcacaagcaaattactcttttgtataaagagcaggcttgtttcatccctttggtggctatgggttttctcagactctcccccacgttgccaaacacttgcagctcagcactatcatggattggtgtctttcccccagctttactgatatataattcatatactataaaactcacctcattaaagtgtacaattcagtggtttttagtatattcatggagttgtgcaaccattacctcagtctatttagaacatttttatcacccccccaaattaactgtgtaccattagcagtcacccctcatctccctccctctctttctgccctaggcaaccattaatctgctttctgtctatggagtgatgttttgagggcccagtctacaatcacttccctgtgataagaggagtcatgtggctactcacttgctcaccttgacagtggcctgcctgatgtttgctcattttcctccattaatttgacatgtcactaattactttagtgtcaaagttggagatagtttacctctcctttcctattctagagactccagaaagggaccttggacaaccttgaagtgaattgcctttctgatctctgactttctacaaccccgtttttggcagatcatcaactaccctttgcccctgagccctggtgatgggaaaccccaagaactggaagttcccttgaggttgggattttgtaacctcagcgctgagcctgatgcctgcctgcctgccacatagacactcagtgtcactgaatgaatgaacttaagcaatactgttaagatggaattaccatacctttttgacacatctgtcactatgaactaattgagcttatttatgctctgtgtgtgtgtgtgtgtgtgtgtcttcaataacccaactgtagaatcattttaaaaatagcaagtaaagctgatctcagaataaattctaggtgcatcccatcttgtgtacgtagcagaaatggatgcatttctccctaccttctgtttcttgtgttgtatgttcgattcctatccaggagaaaacaagatgaggctttatgttttagggaagaaaatggaaggtttagagaacatgtttttatttattgttttctaaaaatgctatagaaaacagtactccaagtagctgttttgattctctttaattcctttcttcttcatctgaggatgaacatctggtagggagtgcttttacttgcaatccagtacactcctattgtcagtccaaaaatatgtggaagtaaagagattccatctcagacccctccaattgccataacagtgggcctgatatagaagttgagaaggtgtcaataaagtgttaatggagatactcaaggaattcagagcatttcaaggcacagcatatgttcacatccctctggtatcagcaaaaactcaaaagtgaaacctgtagggtcatttggctttcatgctgtccaacaataggactttaaaagccacacactaaggagcagaatattgaaaattactttgaactttcaaagctaactatctaaaatatcctagcaactttcaaaaagtgtgataagcaggaagtgcagcactttgtaagacacgtgcatgctcttaagcagaagcctaaaatgctcctaatttgtaccagagaccttatcaaagggcttcgcaaaattccagttcagcaattatgaggtattagttgagtttaacctctgaatcatagggtggggagtggagaattgtcatttcattctactttcaactatcaaggcagatggacctttctaaaagatggtggtgggtgagtagaaaaggaattgataagaaaaaggagggactttgaaagggcttctcttttcagagctggcatgactgtctctccagtactctccctactacacatatttctgttttgtaaggagcccctaaggatacatatacagatatccttgggggctccttgcaaaacagaaatacctttggaaagttaaaagaaaaaatggggtttcctataacctcttttttttttttttttttttttttaaagacggagtcgctgtgtcgcccaggctggagtgcagtggcacaatcttggctcacagcaacctccacctctcaggttcaagcgatcctcagcctcctgagtagctgggattacaagtgcctgccaccacacccagctaattttgtatttttagtagagatgtggtttcaccatgttggccaggctggtctcaaacttctgacctcaggtaatctgcccacctcggcctcctaaagtgctggaattacagatgtgagccaccgcgcccggccttccatacctcttttaagctgttgtcccagggtctgggtggagtggcttgtgtttgggataggagcagcactcatttcaatgaaatcacctgcagaccttggctccattttagaatgacttagaacgtcctgagaagtaaattgcttatcttggggcctcagtttctgttggataagttaattgcctctccctatgaaaaacattttaagtggtataatggcctaaggtttgttatatttatattaacgaatttggacaaagagaaatcaactcaagcaatttttttttctgtcaaagaaatgctatacccattaaggacaaattttgtgtataaagatggctttatttatatttagaaatgatggctgcaggcttttatttgatgagtttgtttagattacaaaacctgagcatattttagcatcagggcaggggggctgctgatctctccaaaaagacaacagtgatttgagtaaagcaagagtttgtagtaatatatgtgtatgtgagtttttaagttctgaaatggatagtaatttaaaataatgaacaccagaattcaaaggactacatatttgccttaagaaaataacacagagcaaattgcctcttagcgatttatagttttatactttgtcttgtttgttccactggtcatggcaaactctgggaagagattttgaggctagtctgagccctagaagtcaagaataaaagtagacttttagttaacagtttaaaactttgccatagtttccaattacatttatatttgaacaggaaggagtcttaggacttttcttcatttcttaatggtgctcataaaacatagtgaatgggaatttgctttaagactaattgtatgtgtgtgtacgggtgtgtgtctgggtgtatacacacccacagagacgcgcatattaactaagttgggatgccatagttggatgagttttcaaatattttagcaaaggtttctgagcactcatgaaacaaaagcattaaggattgcttgtcatagctaataaagttttcttggatctcacttaatttttctgcttcacttcacagagtaattgaaacttcctttttgctttgagttcccctcaccccacccccaagagctacagtcttaaaaggacatctcttttggttagcagttctatggatttttttctgaatgtagaactaggtcctcaaatagttattgagctagtggtcattcaatccttagaagggaaattagttaaatctgtaagtggcttctggaggttgaagaacatccaaggagaataaaggcttattacaactggagcatttcaagcatctgttgtgtaagcctggaaatgtgatccaggttgaaaagtagagatgatggaactgttccattggaacagtgaaggtatgaaaaaataagctccaatctcaaaaacaaacaaacaaaaaccctgaagaactttataagtataggaattatcagttgatgcagattagccaaaatgatgaggttttcctgtgctccatcaatagttatttgcttctttatttcaaatcattctctagaaaattgtctttctccatcaaatgaaataaccttggaagtcttaaccaattcttgcaaaatggctcccctctgtcttccctccagccatgttttgttttgggttaacagtaaaagacaaaacagattgttgactttttgccagaaaattttggggacagattttgctgctgttgcttctgacgtgaacaaaaacctcagattgcatatcttctattctcagggcaaaaacttatttttgaagcaatgtgggtgggttttgaggcgtgctcttctgtttttgttttaaagcatttggtaagaagacacttgactttgaaattttattttcatatgtactggcttgagagagctgacctcccacctccactccatctaccttgtcaactttgatttttaacgaagtaatcaactagttgatgtaacatgcttattttaaaagcaatcatatgggagtgatttaacctttttttttatcaagttgagtgttaattattttgatctgcctcttgaatggtgggttgttaatagtaatattagtcacagctggtatgtgagtactcaactccagattccttggttcaatatttcataggtcattaaacaattttctgatgaaaatgatttatttaaactccaattctcaacctcttgcttttcacaatcccttaggataattaaatgcccagtactgcacccctaactagttacttacttttcaagaatcctcacttaaataatcatatcatatgcagaaataattatcctgcaaagaaagctttgtgaatacttcggtgtttaattcagtttaaattcatttaggagagagtagtacaaaatggctgcattataattcacattgtgagcaaagtatttttaaaatattttgacattcttgactaggttttcatgtcactctttatcaaatgcatcgtactactatattaggtttctttgcttaactcacactgtctaatgggaaaaagttcaatatcatttaagacagactctagttatctcatttgagcgacaattgttctgggggaactgtaacttaacagaaatataagaaaaacaggaactagggtcaaaagccccacagggtataaaagggtcataacctctctcagaggaggcaaatgtaactgatatactagtttttaaagggcacttgattgcatgaaggaatgcagtaacaggatttaaagcaaacatacagcactaacaaagattaaattaatggtgtgccctgctctggggggattaaaagaggtagttttatataaaattattgtgagtagactaagattaatttcctgattttgcatatcataagatactgtaatttatgatatctgctgtgattcttacgtttaaagtagtacctagactttgatatgcgaacaaaattaagaaaccatgtcaaagtataaaaataatgttactcggtcgggcgtggtggctcaggtctgtaatcccagcacgttgggaggccaaggcaggcagatcacctgaggtcaggagtttgagaccagcctgaccaacatggtgaaacctcgtctctactaaaaatacaaaaaattagctgggtgtggtggcgggcacctgtagtcccagctactcaggaggctgaggcaggagaatgtcttgaacccggtaggcagaggttgcagtgagccaagattgcgccactgcactccagcctgggcaacagagctagactttgtctaaaataataataataataatgttactcaatgttatattgaagtaatttttctttatattcttagatggtaaaattaccatgctcttaaaaaaaccttaaaagtgaagttctaagtgaatcaacacaatttttagatgatatgtcatgagaacacaaaacacatagaaaaatggtaaattttattaacagtgcttttatgaattgaaaaccttcccttagtgttggatacggaggctagaatgaattccacaatcaccgtggatgtttggagtcctgggaaatgtgctgcagagctgtgtaaatgaagtgttgctgcctccaaggtgtcttgggcctaggttggctatccacataattgaaattaaagtaaaacttcatatgctgccaagaagacaacaacacatccagttaatctccaatagtgttttaagatgattcacaattggaagataggtaacatggtgtttaacaggtatgccatgttttttgtcattttattcaaaagaatctcagcaaatagataattttctttttacatttttaaaaaagagatggggtctcactttgtcacctaggctggagtgcagtggcactgtcatagcttgctgcagcctaaaactcctggcctcaagcagtcctcctgcctctgcctctcaaagtgctgggccactgtgcctgccacttttcttgaaaaattataggtaaggaaaggggctcattgttccagtttcgcctagcacagttcagctttacacctgctgtcctagcatagttgttattgttcttgtttggagacagagtctggtctggctttgtcaacttacccggagtgcagtggcacaatcatggctcgctgcagcctgaacctcctgggctcaggtgatcctctcacttcagcctcccaagtagctgggactacaggcaggcaccactatgcccaggtaattttttaattttttgtagagactgggccttgctatgttgcccaggctggtctcaaactcccgggctcaagcattctcccgccttggcctcccaaagtgctgggattacaggcattagccaccgcacccagccctcagtataattgttagtggcaccttctttcactctcccatgtgtcctggtttggcctataatttgtggtcaccctaagaacaggaaacagtatattcacagaaagaacttgctaattaaaaatgatttaaaatagttttgcttaggaagaaaacattatgagaactttacattttttcctagacataacttagcctaaggttgaggaaggagacaccatcaagtcgatctcctggctaagcaggttacatatacatcgcaagagcactttacaaagaggcaagaaagccctataccccaatgtctgaaaaggatcacacagagtagaatttaatctgattttgatggtgttaccaatggagggtattgactgcaagttgtctgagttcttggcgttttgaacaaaggattggacaaaactcacagcaaagcaaggaataaaagaagcaatgaaagcagagatttattgaaaattaaagtatacttcacagggtgggagccacctgagcagcagcttaagggccctggttacagaatcttctggagtccagataccccctagaggtttcttactggccacttggtgtacaccccatgtaaataaagtagtggctggcaatcagaggctgaagtgaagttacaaaggttacaccctatacaaccaatcagaggctaaagtgaagttacaaggttatactcctatgcaaatgaagacttggcttgcaatctgattgattgtggaaagcaaccaatcagaggtactttcaattttccatctgccactctgtaagggatgggggtttgcaaagggagtagcctctctggtccttttgttacttaggtgtggaaagttggggttttcctttcaattcaccgtgaattggccttaggttccctgcctccagaccctattctcctgcctcagtggcacctcagggccatcatttcgaatatcacttacttctaccctggctacacacacagatgcagtaagaggccaggcccacagtctagaaggaattgttcaccatcctattataaatcattttgataatttttcttaagtgcactggcttactgaggtttacctgccactttttctgcccacagagtctcacaagctggcctgtgttctgttctctgaagatcccatgcactgtagtgcttagtgctggctgtagtggagcccaaccttttgtagtctgagaaaaccagtggtgtgctctataagtgagacagtattcagtgtgcagaaggtacttggcagaactataaatccatagacttttggaaatatctctaagatccataggctgggaatcacagaactgaaccattgaaaacatgtgtgtgccattatgtaataacatttggagctttggtcttggaacttgatattatgatctgacatgcttttacacttgaatcatctcagtgcatacctgattcatgccttcattacatacttttgacctctgaaatccatgaagctgataaggacttgggaaggctgctctcatagcatgtaaacacttggaaggctgatgaatgttctgctgtagtgttatatcctttctgtccagctcttgagggattgcttattaacatttcattatccagtcatctgccatttctgttcttactgactaaaaaatgtgccctgtaacctaacatccagtataggacgttgctccatctttttgcaaagaaaagtatgtgaaacaactgtaactatttaggaaagatgtgtaatgcagaaaatagtgcatatttgtaggttttaacaggcttatttcctcttctaccaaaaactaaagagaaatcagtctgcaggtttagatctttgaaaataaatgcattctaacttttatatctttaatagagattcctaagatgttagtgttctgaagcatctttactatcattgtttgcatccagcatcagattaaaaatcaaataatttgagtgtgatagagctgttcgttggagggtctgcttgagggtagggaggctcaagagacccagatctgaaactcagcagcctctcaaataggtagttttgacttgggggcttggcaaaatattgtcataactgcaatggaaatggaagtgagaagaggtggatttatggcatgatccacattagactctgagctccctgagggcagagaatgtgctcatttttatctttagcattttgcactgtacctgatgtattctagttactcaataaatgttggttgagtgactagagaaagaaaagaaagttggtgaaggtcgaggcaaagcaaacactgtagtggtgaacggttgatgaaattgtcataaaaagatgaagttttaaaaattaggtggaaaccacagggtgtgtctacaggcagccaccaaaactgcagttgcaataaaataaaacattaagaaaaaaaaattgagaagctttaacaaaaaaaacttacttggctttggagctaaaattccacagctgtaatcagggaaaatgctctgcccagcagcctgagtaatgaataaaaagaattttcagagagaaaagaaatcaacaagctctgtgactccccccagaaaggccaattgctgcctcccaccatcttttgacaagaatgacattttacccacccatgccaggcttctaaaataagttgataatgtttgcactcgctgtattagtagaacatcttgatatagaatgaaacagtcttaaatttcttagctactaggaagcacgttttttagctgtgtttggaacagtgagtattcttagattttcagcagcattcgtgtctagatatctttggaataatttgttgtgttctgatcctgagagttgattatgtgttctctttaccatttctgaaagatgtaattcacatgaaagttattaaacagaaggttatctgattcttatttactatttcattctacttttacaattatgtgtgtatattgaagttcagaatgccctgtctaaattttaggttgaaaacaggaagtagtgactaaatttaagtgtgttttcttatttgagggattaaaacccttgttttggagtttgttttgttttgttttggtcatcacttccaatttaaatgctattgttgtttctggttgcctgagcagtatgaaacatcagcttgtggagaccaataacttgtgttaagcttaaatttgaggccagtccagatggaattcttcactccagaatgtctgtgaatggcatttcctcagaaagtgtaacagaatttttggtccgtatgaccaagcaattccattgctaggtataaacccaagagaattgaaaccctatactggggtgggggttgggactcattctaactttggaaattcttgagattttagtgttctaaaagggtttctatatcaaatatatacagcatcagaataaaaatcaaataatatagacatgttggtagcagcattagtcacagttgccaaaaggtggaaacaacctaaatatcaatatcaactgttgaatagataaacaaaatgtggcatacccatgaaatggaatattatacaaccataaataagaatgaagtactgatacatgctacaacatggatgaaccttggaacactatgttttatgaaaaaagccagttcagaaagattacaatatgcatgaatctttttatgtgaaatgtacaaaataggcaaattcatagagacagaaaatagattatgcttgcccagggctggtgtgtgtgttggggaagggttggaggggtgactgctgataggcacaggatttctttttggtgtaatggaaatgttctgggattagatagtggtgatggttgcacagccctgtgaatatactaaaactcaatgaagtgtacactttaaatgagtgtattgtacaatatgtgaattaaattttaaaacatgatgggggggcaatttctggagaggggagcaagcaacatgcccagcaggacattattcacttgagtttcagatttgtagtactctaatgctaacagcatggtttgcctagctgatgagggttggggaaaaagaaaatcaaaagctggaccacaggagaccagggttctcgtcctgatcaaatgcatttctactgtgcaaccttgtagatagatgttgggaagagaggaatgagaaaaactgtatatccttttcataattaaatgattgagagtgtttggggaaggacaagagaaaaaagagctgtatgtttaaaaacagaaataggccaggcaggtgtggtggttcatgcccgtaatcccagcactttagggtgactgaggcaggtggatcacttgagcccaggaattctagaccagcctgggcaacatagtgagacctcattcctgcaaaaaacaaaacaaaacaaaagaaaacaaaagcactaaaaataactaaaaaatgataataataaaagattttaaaacacagaaataaacattcctcagggcgaggatgtgcatgtgtggttaattcctaatactgaacaaggcagggttttgactacagcttagccagacactccttggcctctctgccatggcattcccagctctctgtcagaatagcaaatcgtagctgacatttgcttttccagaaggaacacccttttgccccattctaccgtcagcctggcttttttgtccggatttacctgttctttgtagtgggagacagctgtgcaatggatgggagcttgagggagcccagaaacctcttctaggaccacagcagcactcattcatcactcagagaggaaacaagtagtttacgagctttcactgaaaagtcatcattgtgtaggttttcatgaaataaagattgtgtgagccatcacacagggctgttttcaggacaactctgacagaggatgtttgttccttccagaaatgctggcaatattgtaagcttttcatccctttaccagggcattactctggtgctgttagtgtctgattctgctaagaagtaggaaatgttaagaaggcattgttctaaagaaatgatccccaaatatcagtgctaagtgccatctatgaccacacacatgtccatttataaaatgccttataaactgggagcagtgctgggtttatatcaaagttcaatctcaaaatcaatgccatttaaaattgtaaaaccattcttaacttgttctttcaaatgtagaacatttgtattatgtttatgttacatgtagggcacagatatggcatgtgacatttggtacattgacatttttagaacaaaaatgagtgacccactgtttttccttgcctcttctgttcccttctctgtctgtatttttccttcctctcctctcctcccctttccttcctttctttttttttttgagacagagtcttactctgtcacccaggctggagtgcagtggctcaattacagctcactgaagcctcgacctcctgggctcaagtgatcctcctgcctcagtctcctatgtaactgagaccacaggcgcaccccaccatgcccagctaatttttaagttttatatagagacgaggtctcaatctgttgcccaggctggtcttgaactcttgagctcaagcaatcctcccgcctcagactccccaaagtgctgggattacaggtatgagccattgcattgggccttgtctatatttttcaagctctttgcttctattattgtatttaatttgttttggagtttttttcttactcagaatcctgcctcctcattctttctctttttgagagaagagcaacttttgctttcgggcactctaatttacaggaaaatgaacgatacaatttatgcagttttgtgttctagaaaatttattatttcagccttcagggttacccaggttttgtatcatttcatttccctggagcactttacacatttaatggcaaagaccagcaatggtgcttttctggtgtatgcagcagcttgttctaaggcatgtggtttgagagttggcgctacttaatcatcttgtttttttttttttcttgagtgttttggatctatttcctccattgagtccaagttgtcttgagagaactcaagaatggtgtgaagtgtatttagcagaatctctcttcccaaatggcaaactgtgtttcaagaaataaataagcccattctaagatataaaccctattttcatgtttacttagctcttttcttctatatcttctgggattgatatttttagtaatatgaaccagctatttgatgccctttgaaagtaacagccttgctgcatgggtcagttttctggtagcgtatcaccagcaaggacatcacactcaggtagaagaaaaatgaatgttcttttttggaatatttcaaaggttataaatgtatatcaaacaaaccagttttccttaataaatcacctcttaggtctgttttctctaacatctagaacttttgtgaagctgttaagttgcagcctataccaactgttgaccttttgcttatagctttaaaataatgtcttagttatcttacttcatatgaaaagaaaatgttatgagtaagagatttttcccttacctatcaaactgtcttttaaacatgttttaaatatttcaatgaaaatatttctaaagtatttattctcctaacttattaaacagaaggataaaaaccgtaatcagttaaaaaacactcagggtcaccattatgagaatcatttaataaatgatgctctaatgcagcaatgtccttagggctctttgaagtatgaggaactatttgcccctaagctaaatggccccagactgttctgctgcagttgcttctgccttccttttcagctgtcacttctgctgtcattgatttgggttcactctttgaccctttttaacccagtgcagaactgaatgtctagaaatcagacagtagagttggttaaatgtgcaactggagtatttgtgtacaaaataaaggctatgttccagagggtggcttcagtctcctacagtaaatttcacagactttgaatatttcttcttcttcttcttctttttttttttcggcaaacccaaggcttcccttgcttagtgggtcatcccacaatttgaagtaatgtataagcaagccattgctatacttctagggttgtttattgaataaatttagtatatcaataggtgataaaagagacaaccattttaaagcctctccatatgtttgattaaaagaaataatattcctgtctttgcacactgaaccttaatctattttcatttgtcttcataacctcttataaagcaaataattgccctgacctttttatctaacatctgaattttccttatctcatttgtgtgtgtcctttaagattcaatgacaatgcacagtaatgtagataacgtgataatactttctgttgtgtttttagcacgctttgtataaatcatatcctcagggtcccctttattcatatattctacttgcaccacccaccccaagagtcctggtttattagatttttctcctttgccaaaatatttgggttttctctccccccccagcataggccttattttcataaatgtgtagtgatttcacctttcccgtaaagttggccagcctgcttgattatggaaattagatttactggtttctacttcccagggtcccttctagaaccccgcttatgaataggaattacattgacaagcaccagtctcgggcacagtggctgtttgtaaagacagcctacacatgttggccaaaacagtttcacccttgagttacttcaaaactggctggtggataccatctggtcccagtgatttatctactcctggtttgttgattagatgcagggcatcatgtttaccactatttgatctagtacctctgacctgccgagttcagtgttctggtttggaaatgcgcatctccttacaagacaaagaattcattcagtctctccaccatctccattttagccctgtgactgtgattaagtggttcctctaactggcttcctccctttgatagagcaaaagagcctcttactatagcctttgcaatctcttgcaagttgctcctgcctagattttattttgtgtttaacctgctgtgccttacaggattttctctattccttctctggactatttttttttctttaatcaccactgctttttcttctgccttttaaccacaaggaaggttctcttctctctccagtccccaccacctcccccgccaatataagtaattattctggggcgactataagtaagtttttttctttcccctttttaaaccagtctccaggcatcttgagggttgtttactttccgaactccctcagtaatgccctgcttttgtcacagattcttactctaatatagcaaaaactatgtaatggggtttgtacttttcctctcccatcaagttgttaaatttaatattgctgtgtggtcaccagtacacatttgtttatccacacttacttggtgtcctaagtcctatgtactactcaagaccaaggccaggtatctcttgggacctttcttcccttcccccctccatccctcatactcctgttctagaagcacttgttcaggaagtaatcatttttcgtgtctccagatcttggctgtagatcttggcaggtaagtattatgctgatgattttttttttcattcatgtctgtgaatcttcacacacaaatgtaagaggataatggagggaaatctatggtaccaatctaaagctgagtagaggaagacctatttgacagaaatatttaagacataaagagagtataagggaggtgatccggtgataaactgacagacgctctaaggtcgatatactgtcatcagcaacataaaaaaaatcagcacttaaatgcatcacaatggtacagagagctgtcatttccatctttgttctcccttcctttgatgtgatagggagccaactcccttcatctccgggtggaatttttgtttgtttgtttttatttgacatacatttatccttagacagtctaaatttccaaagcatctgcctttatttcatagagcggagagttctttcaacaaaatgattggctattaggaagaaattgatcatttgtcaggatagtgcagcagacacagtgcatattctgggcacacaatatttttgtaaagtcagatgcatatctactcaagcaaatagtgtcttgtcttaatcttttgaattttattcatgagttagatattctaggatgcaaatgaatcatatttatctgtagaaacctttggatattgttgctaagttgattccccaaaatattcagtcagactatgtgaaattgctgatatttgacctatttggcctaaaataatggcactctcataagaatcaacctttaatattttgtttttctttaatctctcaaagctcataacagaaccatttcaaaagctaaagaaaagattctgtagctcataatcctagagcagtattgcaggttgtagcctgaatttttatcaagggactgttttgtctttctgctaaataaagctaaatttccatttggtctgtaatttttagaaataaatatttccaaagactaaaaataatagtaatgataacaatagaaacaacaagaaaacaaacactcccccattggttaaacatagctgaactctgaaacatagaaagaatcccctttctgagaaatatatagcatcttctgatatcagtgttcataataatagctgctattgattgaggtatactgtataattttaatgcttctaacaactctctgaggtaggttctgctcttgtcctccttttacagaagatgaactagtctcagagaagttaggagggtggctcaaaattgcacagttggtaagcaacagaactgagcctaagctgggcatggtgacgtgggcctatcatcccagccaccatgaggtggctcgtgcttgaggtcaggagtttcagactagcccgagcaacacagtgagaccctgtctcttaaaaaacgaaaaaaataccagatgtgatggtgcatacctgtagtcctaactgttcaggaggctgaggtgggaggatcatttgaacacaggagtttgagggtacagtgagctatgatgatgccactgcactccagcgtgggtgacagagacgccatctctaaaaaaaaaaattttttttttttttttgagagagtcttcctctgtcacccaggctggagtgcagtggtgctatcttggttcactgcaccctccacctcccaggctcaggcaattcttctgcctcagcctcccgagtagctggaactacaggcatgcaccactgtgcctggctagtttttgtacttttagtagagacagggttttgccatgttgcccagactggtctcgaactcctggcctcaagtaatccacctgcctcggcctcccaaagtgctgggattacaggcatgacccactgcacctggccctaaaaattatttttttaattaagaaagaacttagcctgaacttgggcttatttacctttgaagctgttatgctttccatataacatgatgcctccctacctcagagactcagaacagagagtccagtcaaaacatttatagctaatttcccacactgttctgacatacatactatacagtatgtagttagatagtaaatcatgctccagacaagcttttctgttctcttgagtttcccacttgttgtgatttatccatttgttttttactgaactgttctgattgaggatccttggtgatgtggagtgtcttagtccatttgtgttgctatgaaggaatacctgaggctgggtaatttataaagaaaagagatttatttggctcatggttctgcaggctgtacaagaagcatattgtcagtatctgcttctggtgagggcctcaggaagcgttcactcatggtggaaggggaaggggagcaggcatcacatggtgagagaggaggtgccaagctctttgccaacagttctctcttaggaactaagtaagaattcactgccaggtgtggtggctcacacctgtaattccagcactttgggaggctgaggtgagtagatcacctgaggtcaggagtttgaaaccagcctggccaacatggtgaaaccctgtctctactaaaaatacaaaaattagtcgggtgtagtggcaggtgtctgtaatcccagctacttgggaggctggggcaggagaatcacttgaacccaggaggtggaggttgcagtgagctgagattgcgccactgcactccagtctgggcgacagagcaagacttcatctctaataaaaaaagaattcgctgctgcgagatccaggccattcactaagtatctgccctccacaatccaaacatctcctgccaggccccacctccaacactggggattagatttcaacatgaaacttgaaggggccatacaaaccatatctatgccatcgcacagaataacctaaaattcttggttcttgaagtgcctgactgttacgccatttttgcatcactataaagacatactggaggctgggtaagttataaagaaaagaggtttaattggctcatggttctgcagtttgtacaagcatggctccagcatctgcttctgatgaggcctcagggagctttcaatcatggtggaagggaaagtaggagacagcatgtcacatggtgatagcgggattaagagagaaagagtggggaggtgccatactctcttaaccaaccaggtctcatgggaactcagagcaagaactcacttttctcccgggggatggtgctaagccattcatgagggatccacccacacaacccagtcacctcccactaggacccatctccaacactgggagtcacttttcaacatgcaatttggatggtgcacacatccaaaacattttcattgacccttcttgttctaagttgctgcttactgctacttactggtggaataaaaagaagtttgggttctgtatgcggtcccaaggctaccaagtgtgtcagtgctgttagaagagttttaaaccaataagcaaaatgcatcatgactatttcttaatataggctcattttgtaatagtgtgttatgtttgtagccacaaatcatggagctatgaaggttcatctcataataacgaaacaatgcttttttataagagtatattttctacttgcccataccaccaagtcattcggccaaatggaagctcagacttggtgctactgagcaccttttcctatgtatatttatgaaactcgagattgaactattgttctttttcaagctcatgcagttctagtatagtcattctgcatgactgaacttaactctagtcaagtaaatttgggttaggttagttggtctttgtactggcctatgttaattgtcatatataaaaaatattaatagaaacactcatgggcaaaaacataagcatgctttctggatagcctggtagaactcattcttatttaggcagttcatttggaaaaatcaggtcttataatgctggacatttaatttggcttcagcctttgaaaggccgttcttccccacattgaaactgatttcagaatatgatttaatgtatgtgctgctgtagcattgcatacaatttaggattatgctgtcttgactcagagttaaaacataagagtagctagattaaaaaaataaaacatggccgggcgcggtggctcacgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaataaataaataaataaataaataaataaaacatgaccttgcatggtttatgatccagtgaaagataaagagaacaaagtgggctgttctctgttctttcatacttctggtactgatactttttaaagtacactacagtgtttactatttcaaaccgataagcacagcactgctgccaagtattatctttaaaacaagaccgacatttaattcagttgtcatatttgttctcatccttgaaggcagtttaaaaaacagttgcctctcattggttactgtgggatcaggaaaaactaggagcttatgtaaatatgcgtgtatctgaaaggagaaggtttatttttttattttcctttgaagtacctttaagtgtactcttaaagtatatcccgaactgcataccattatgtgttttccacataggatgaaacatcctcaaggagaggggctaaaaataagtatattaaagtaacttactctttgctggcagaaggtcctggtacaaaattaggtccttgaattttccaaatgaggttgtatttattgcccttcttttctaagaaaggctattttaataatttttgctatcacatcaaagacttttcatgataattatagtcaataattgcagtagtaatgctgcgtgccatctgcaggctctgtgtaatggaaactagggagaaaaacgtgtccctgtgcttgatgggagttaccacagaacgaaagaccctggtgcctgatcaccacttgcatcagttgtaggtgactctcccactcctgggcccttggtcatatatactgtcttttttttctccctttctcctttgacccatttccttccatttctttttctctcactccttcaggcctctaatgtgcaggagtaagagagaaagaacttccccatcccccatgtttgttgctcatcctaaagtagctgacaggccacattctaggagtagaggagtaattggaacttctttgggatcaagtgtttgaccaaatcaattggtttatgagtgagcagttggcccattaccaaaaagagttagagagggcaagctagacattgaagtaacggaatgagcacccactcacccagttgcaccaggtcagagaaagctgtctgatactttcaatttgtgagcatccggtctcaagcttgtctgtgggccagatttctgaagtgctgatgtttctcttaggtcctgtgacaggcattacattgtatagtaactccaatatcagccccatggaagcaaccctaagttcttacaggctcaaattagagtggctcctatcctttcattcatacccaaagcaaaaatggtaagatgcagccgtttcattcttggttagttctgcagtaaagaagtccaggacacttgcagcgcactttctggagcatttgtatctatctctttggcccagtggtgcctaagagggccctggtatggttagggttatctgaagatgactaggaattgaacaggccttacttgaatgtgtagtaaatgactggtttctctcttttctgtgtcacttgctgacaaagaggcaataacttttccatcttcttctctaaggaagtaaatttttttatgtcataagtagacacattaatactttaatatagcacctaagatctggctttatttttccttccctgtggtacttaagaaaccagaggaaaatggcgggtggctggatggcagcccagttgaagaattggctaatcaataccttgcctttgagttcaggcacctttttatcagggttttttagagcctagaaaaaaacagggattattcctagtgtgtggagaggcactgggtggtatctcaaattgttcgttgttgagtatatatcagtcacttgagggcatagaagctctcctctggtgagacctctactacaaaaattgaacggagctatgccaataatttattgactatccaaatataagtttagggaagcttgttatcaagtgaccaggttagggcctttaaaaatcaaagcactaacattgtctgagttttttttttttttcttaaaaggagatttgaatgtttagtgacttctgatttgtcaaaccaaggaaatgaaacagcatgtgtgtgggaagtctttgttctgccgattttgctttgttgaccaagaaaggcagcagaactaggtccccaaggagttttattcacccttgccttgtcagattttgctctgagtccgagataatgccttcagtagttttggttgtctcaaaaatggacatagtatatatggcaatgtataggttatatctgagtgtgtgactctctcctactttgtccaaaggcacctcctatggcacatctgttgaagttccaaagtgagaagaaacatgggttgagttgatttgcctgatttagcatcatctctcctgtcttttggacttgagttgttccaagataagattagaggacctcagagatcttgtggtggggagggggttggaggaattcacattatagagtaagaaggagagagaaaaagcctagagaacaacaataaaatccatgtctgttcatcttgtaattttcaagagggcggagaccaagccatttgtattttctgcactgatggatggcatctggcacataagagtcacttgataaatactgcattaagcaccaacaatgtttttgtgttgccaaatcgggtcaaaggttagtttgggagaagtgaatcaaatctttgacttagacttggggaaaatgttagggcagagttccattcccagataatctcttgcagtggtctagttgaagtaactagttcacgaagtggtaaatatagtggattttctaatcataatgaataaatcaaatgtagttaattaacaggtctgattctaaaggaaaggttctgaaaggtgagattggagaatcaaatggtgttaagaagccactaggataagtcccagtcagacctggggtgcctcactaataaaggcaagctggtagagtctataataaaggctgaggacattgaaaacttaagcaaactcagtcttccaggaaaggcaacttcgttaaataaggggaatctgtgctttgctagtgaccttgtgtttctcaggtggctaatgcatatgtagagaatggaaaaccattgcacgtgatctatttaggttttcaaaaagctttcttggtggcggggggcagttgatgggggggttcacaccaagccaaggaaactcaaagtaactggcacaccatggaattgtgggactgtttcgtcaaatattatgattgactttgaggcaggaaacaaagggtaagggataaacacaggtaattctctgaatagcaacatagtggctttcactccaaaattaggactgagacaagttttacttaaagctccaggaactgacctggaagaggaagtacacattgaaatctttacatttgtcaacaaaacttttctaaataacaaagagcctattaaatggtaataaattgtagggcatgtggcccaggtgctagggctttagataatgggtgaggaggagtttttgtttttgttttgcttttactgaaaatggcatgcttcatattgcataacatgctgcttgaagacttcatggccagttgccagggttggggaaactcagccttgcaaaacgatggggagtatgaggagggctctgcctctccctcatctgcccattccaaggttcagaagaatttttctctcatgttataaaattaacccctggtcaactgtggctcatgtccatatccataggaactgggacttattaacagtccttcagtgcagatctgtatcagagtaagccgtaacttaactatgacttttagcaagaattttgtgaagtgggttttaaaggatgtaattaagcacagacattaaaaatgtaaatcttactttcctctgcaccattttattgatgcctagctagaattttgaggaatggtttgcatggatcactgttttttgttttttgttgttgttgtttgtttgttttgttttgtttgcagaatgaaacattcccccccaccccactccaaggcttgagtgcagtggcatgatcatggctcactacagcctcagcctcctgggctcaggcgattctcccacctcagcctgcctgactagctgggactacaggtgtgcgccaccatgcctggctaatttttaaattttttgtagagacacggtctcactatgttgcccacgctgatcttgaattcatgggctgaagcgatcctcccactttgacctcccaaagtgctaggattacaggcatgagccactgtgcccatcccagaatcatttttctttatgtgaggaagtggactttgccattggtgggtttacataaaggctttctagatagccatttggagaaatatcttttggagaattaatgatgaatgaatatgttattcttctggtatattttttctagacagtaaatttactgaaaacctcttaccacgctgtattttgaggggagaaattttgggtatattgtgaaaaggagggttaagagaagctaaagacagcttttaccttcccttttgtttaagctgaaagcaattactaaaaaagagaaaataatttgatgttaaaaattgtcatgactcagccgagtgcagtggctcatgcctgtaatctcagcactttgggaggctgagggggaggattgcatgagccaggagttcgagaccagcctgggcaatgtagtgaaaccccatctctacaaaaaatacaaaaattaaccgggtgtggtatcacatccctgtagtcccagctactcgagaggctgaggtgggaagatcacttgagcccaggaggtcgagactgcagtgagctatgttcacgccactgcgctccatcctgggtgacaaagcgagaccctgtgtctcaacaacaacaacaaattgttatgactcacacaatccatgaaatgtacgtaagaaggcagactttaatcattcaattagagcaggtgtctgaaatgtctgatatctgtgagcctccccactcaccaactgtattttcttctacacttgcagcaaattcagctgttaaccatttcggatattcctgtgaattctaaatggctgtggcaggctatctgagaatgagattcccaggatcttctttagagattatttggaaataatatggaaaatcatctgctgttggaagtcagtgttgattcagcccctaggggaggaggaaaggggtgtgtctgatgtcttcctgaggataccttcttccttttgctttctccgaggtcttctgtgatggtgtgcaggagactgcccactggggcagtcactggagatgcaaagaaagggcaaagtgctggcggctagccctcccctactctgagaatcaccatgaccttccaagccaggtctgatcagctgtctcagagatggccctgctaaggccttggtctaccagctattatgatgtgtggcttggggatacaggttccagagggaaaaaaagtcctcaccaatggcgttttctgtctaggctgctttttattcatagctgaatgtatcactggggctctaacagacgtgatcaaccctgggaatctcagtctccatacagtctctcatctcactctctgtaaaaagaaaacctcagagttaggggagtgggagtatgagaaaaattcaccaataaaacaagaaggactttgaggagagttgtggaaatcttaatttcataggcactatgtaacaaacaccttcaaagtctgtgtatttgtttttctcttaaagagcttgaaactcacatgtgactccttcatatcacttgaatgagtatgaaatccgtagaggcatttggaatcatttatttatccctaggccttctgttaaattatgagcctagtgaaaatcataattgctacttaagagaaattctcaaacgatgctaccaagatatgtgcacctgaattattgacagaaaagatctcctttgttagttgcaaaacaagtaagagagctccatcttttcctgtctgctccttgctatcccgcaaggtcccccagcacacttctgtgagccttttattagcactgcttagaaagtatttacaggagcctcagaatttttggagagttttgggttaatcactagtagtattactattccttttgagtcctggaggtagtggttgtaaatgtgcaaaatagatgcagttgcttcagctgctcagaagtgatggcaacacaaggtcaaagtgtgcatttcaggccattcactcagtttggtttggtgtgccttaataaacctttggtatagttaaaatggggatctaagattgtcagatattaaccttggttgacaatttgcttatcatttgaaaagcagtaagaagccttggttgatttctgtctggagtgcagtttaaagctattataagctcattgaaatgaagtgtagagttttaaagtagcaaccctaactcttccaactacacttacataaagttattcttagaaaaatataataaaactgattattgaatgtatgtgtttctgactggccttctctatactaccttgcaggattagtggacctagaaataattggcagtcttaagccctccagagctatattttggcaaggttttgcaaaatgctaactggctgcatttctcctactgattagtaggtgatctcaaatcatacatctgcataatgactgtaatttacgtgctttgttattaaggtcagatgactccaggctttggatgcacatagcacattttatgcagtaatttcactcctttttggaaggagggaggatggattaatgtacacgtccccccacctccctggagttattaaaaacctttagagattttctttctttgttcccatgaagcagagcattgtatgttcctcatggggtcttaggtagcttagaggggctggagttatatagcaacctgcattttagttcactttgtggctacatgaatttagatctaagaaatgaacagaaactattttggtaatgctttagaccaacagcaaggaattattttacgtttagaacaataaaaattagaaaaagagtaaagtagcaattgagggattaggaaaattgctccagcaaataatagcttaatacagctccccaatattagaattacatcaagtatttatatttttgaaagcatgatgaaagtttttccccgctggccacatgtatttatgctttttaatttgaaagccaagacttgcttttcttaaaaaaaaaaaaaaaaaaaaaaaaaaaaaaaacttctaatagaagagttttagatttacagaagttgggaagatagcacatagactttcctatatctcacccccagtatcccgttattaacatcttacattagggtgggtatatttctcatgattgatgaaccaatattgatgcataattacgaactaaagcctacacttaattctgatttcctgagttttttggtaactgtcttattgggatatagttaatataacaaataattcacctatttgaagtgtacagtgacttttagtatatctacaaggttgtacctccatcaccaaaatcaatttttcatcacccccgaaagaaaccccgtaccttttagctggcatcctcactttcattctttcccctctcccccagccctgggcaaccaagaatctacattctatctctagatttgcttatgctggacattttatataaatgtggatttttttcacttagcagtgtttttgagattcatccatgttgtaacatgtatccgaatttccttccttccaatggctgagtaatattctatttacagatacagtagaccacattttgtttatccattcatttgctgatggaaatttggctattatgaataatgctgctatgaacatttgcatacacctttttgtttgatttccttagtttttttccccacaatgtacttattctgttccaggatcccatccaggatatcacattatatttcctcatcatgtctccttaagctcctgtggcttcgcttttgatggccctttgaatcccttggttgatggcttggtcaccatcagttcaccatcacatatgcatgccgttcagctccttgatgtgccctatttccacatctttctgaactagctagaaaagaaaagtttgttaaaagaaaaactttggacatgaggcaggagaatagggtctggaggcagggaacctgaggctgattcatgctgacttcctataactaaattgaaaggaaaaccccaactttccacgcttaagtgacaaaaggaccagaggctacttcctttgcaacaccatgccccgccccgccttccccctttttctgcatggcaggaggaaaattgaaagtacctctgattggttgctttcccaatcagacatttgcataggagtgtaactttgtaacttcattttagcctctgattgcaggccactacttcatttgcatggggtaaacaccaagtggccaatagaaacctctagggggtatttggaccccagaagattctgtaactggggcccatgagccactgcttggttggctcccaccctgtggagtgtactttaattttctgtaaatctctgcttttgttgtttcattctttccttgctttgctgtgcattttgtccaattatttgttcaaaacaccaagaacctggacaacttgcagtcaagaccctctactggtaacagacaaattaattttaacagaatttaactgagcaaagaatgatttgcaaattgatcacccctccccacaaccagaatatgttcagagggattccagtactgccatgtagttggagaggatttatggacagaaaaggaaaagtgatgtacaggaaacggaagtgaggtacagaaacagctgagttggttacagctcagtgatttccttatttgaacatggtttgaaccgttggccacctgtgattggtgcaagagcaagttacagtctgtttacacacccagtttaggttacagttcactgtgtacggggaaacctttaaaccaaactttaaatgtgtaaggaggcagctttaggctgaacttaacaaggtgctgcttttctggcgcccctccctcacctagtacaagttgtcagaaatggttcttaacacgaaacttcagtagcttatcagagcataagagatgttcatttctttctttgttttgcaattgtactgtcttacatttacataatgcctccttgttttcaaagggcttttttcgttttaaggttccagtggataactgactttcccaagagtctttaccaaaagcttcccaatcatgtagagctgggcttcaaacccatattcctgacttctagataaaacttaattatccctagactgctgctgttatctctgcagaataaaagaaccaagtagttttaaatatttggaaccttttaaattcactccttaaaaaaaccccttgtaaagagctaagttttcttcataactcaagtgaggcactcttctagaaaggccaatgcaaaatcatagtctcttatgtttgcagttttcatagtgctttccagtctgttcttctcaaatgttcctcactgcggtccttacccttaaggaacagtttgtctctcttatttaccataggcatttggttgctttattggtaaaattagtccgagtaccaagagtgtctgccttaaaaatcccactggtgcaggcaaagcctgggttctctaccagtgtcttgcaatgttttctggctctgttttctccatttaggacactgggggagtaaacactagagattttctttatttcccgcaggtacagaaagaaagctgacccctaagtggtaactaccggtattcctctattactgccccacctcccaaaaaagtggggagaattggagagacactttcttggcatctagttggatttctaaatgtattttctgagagagatatagaaaatggttgttagacatagttgaaaatagtcaccgggcgtggtggctcacacctgtaatcccagcactttgggaggctgaggcgggcagattacctgaggttgggagtttgaggccagcctgaccaacagggagaaaccccgtctctactaaaaataaaaaattagccgggtgtggtggcgcatgcctgtaatcctagctactcaagaggctgaggcaggagaattgcttgaacccgggaggcagaggttgcggtgagctgagatcacgccattgcactccagcctgggcaacaggagcgaaactccatcaaaaaaaaaaaaaaaaaaaaaaaaaaaaaaaaaaaaaaaaaaaaaaaaaaaaaccagaaagaaagaaagaaaataaagaaagaaagaaagagaaaatagtcaagttagtagtaaataagctgagggctggcctgagcacctatctaccatttataacattttctatgggaagctgagttatgagcaactgaaaataaacgaacattagccgcaccccatttgtacatcagaggcagcctttggtgagaggagtaaatgagataaaatgagaaagcacagtttcacagattgcctcagagcgctgttaaatgatggaatagattcctcatattcaatgcctacttctttaaccattgatttgaagtgcctcaaaaaaaaagaaccaatacacactcagcaggattgagagtaatttattgtgattgtctttgttcagctttgaaaactaaggcattgatattaagactaaagagaaattacatagagctggtgtgattgaaaaaagtttggctctttcgagtgattttttttgttttgtttttaatgccagagagttaagctttaaaagcacgcttcattgaatcccatccaagcctcctaggacagggctgggggaccttttttctattgagggccactgacccacaaagaaaaaaactaatcaagggccatgtacaaaaagcaacttaatttaggtgcttccttggaaaaccataaagcattgaattcacctgctttttaaattaagaacaaggaattctcaacaagtacaacaaataaaaaaacccttcagtttcatattatgcaccacttaagaggtggggtgggataagagagaactacatggttagagtgaaaagagagtggaaagcagacaggagagtcttaatggactagaagcgatacatgaagaagaaactgtatgtcaagagccatggaagcaggagattgaattagggaaataggggagagaaatggcagttgtagatcataatctactattcactaaggtagtagactaactggttaactgctatactcagctgttccacagctggaattcagaagcctttctgacaacaattcttaaggaagggtcagaatcacctagagcccttgttaaaaagtgcaagtgtccaatgctacccccacagtggctgtctacctgtcccatctttattctgttgtcctcgtgttcagctctctcagcctaaaggaaaaattgtggcatctttcttcagtgagaagaatataagatcaccgggcttagaaaggaaatctccagaaagaaaagatttctcactcaggcacagcattttagaagcagtctcaaacacataagacagaatgcctttcaaataatatgcacgccctagccttcaaaataaaccattttgggtgcttaaagtagaaatattcaagttaaaaaaaaaaacttaattagttgctcaagtcttcaaagattttttaccagaacatggagctataatttcattttcaaatgtacccagacttgtcctccttttcctccctgtgcttctcattagcactaactagttgtggcaccgaatccccagtagcccaagaatgtcttggggtttaattcacaagtgtgtcttggactacgtgtgtcacagggcttttggcaagaatgtcaaattacattttcaagtaacgctttttagaaatgcagacaggataagtggtgcattcggggctatatggcccaaagtgtgaactttgcactgaggggcagacgactttgccagcagaaacattagccaagtatctaccctgttgttgtcctttacataaggcaagcctttcaccattagacaaaatcttcccggaaagatctctctgagatgaaagtgcactatttttttctttttaaaattagatattgcaggccgggcatggtggctcgcgcctgtaatcccagcactttgggaggccgaggcgggtggatcacctgaggtcaggagttcgagaccagcctagccaacatggtgaaaccctgtctttactaaaagtacaaaaattagccaggcatggtggtgcacgcctgtaatcccagttacttgggaggctgaggcacgagaatcccttgaacccaggaggcggaggttgcattgagccgagatcacgacactgcactccagcctgggcagtagagtgagactctgtctcaaaaaaaaaaaaaaaaaaaaaatagtgccaaaacaaagacgtgccccagtgttccagtatcagcaagtctcgataaggttctgcttgagggtcactggtggagatgagatgggtggagtgcatgggccactctgggccttttatgtgtggcagtgtaaatggtgccatccactcggaccaggttactaggaaaacttttattgctgctacccgtttttgaagggtgtatccttagtataaattccctgtgggtgagtttaaacctgtcaacatctagcaccttcttcaacagagaaaattattatttcctgctgtctcttagtattttcttgctttgaggtgtatgtgtgtgtgtacgcatgtgtttgtgcatgtacccatgtacactgggggcagggaaaaatgatgggtacttttctgtgaacttagaaacctattttgataggatccagtaagtgaccctttattaggtgtgaaccctgttaacattaggtgagtatagtttattttccaaactgacaagttattttgccttgaaaattcatgcataccacaatggaatctttgcaggtgcttgaaaaaacagcctatcctatgatgaattttagcttatagcaatctttaaaaattttatttaaagtctttattatgaagtaattcatttaaatcaccctatgtgggttctcattctgagcattccaattcattttctacagggggtatgaatataatatgtattatttaatatagtgacagcactgtactatttgggggccttcatattgttttatgtgtttagattgtaatggagggaacccttacctcaacactgaaaccaggagacaactgaatctttctgtgttaattatgtgtcccagtaccgaaggcctgctgtgaacttgttaagccagtgaagagggagttttgtttttggttgtaacaaaggtgtttccataaaaccgagccttagcaacccctcttctgtcactaatgagatctaagatattctgcagactcacagctctaaacttgattacacaaccttttttttcccttttttttctgttagtagaattatttattgaccaaggttttcagaaatgccaaaataaacttttagcagtttctggatgaggaagttatttgaagattgttgctctttctgccttccttacatggtcctttaatgctgcatactccccttttttgggggcactaacattctccctactttttaactgccaggaaggaagaatgatcgggaacatatatgattatataattatttgcatatgtgcagttgacaatctagtgttagtcaaataaattgccagctcaattttatctgaaataccctgctaccctaaagctgctttgatatctccattaggtgaagccctatttcctgtaagtacacatggccaagaagcagcaatggccagctcatggaccatttcgttttccatgattagtgttgtttgaatgattagcttttaattccccatccctttgttgattggtcacacttaccattgacaggttcacatgtcttcagtatactcattcctgagttcctcagatcatctctcttttcagaccccttttgacttgcatagaacatggacagcaatagcagaaggaacagtgagagtcaatccttgtaaacgtgtacaaaattataccacaccaattaatattggagagactgaagtgatagtagctagtggggtttatttttgagtggcattgcatcttgtggtcattataagagaagagacatcgtctcttcaaagcacaattttgttctgtgacagaggagaacaagggggggaactctggggcatatagaaaaaaccccccgcccaaccctcacctccaaactgcaagccaaatgcagttggtataagggagggagatacttcgtgggttgggttgctgtggagtgatgtgtctttgacatttcccttgactcttggggctgcatcactacataaaggtgtttattggaagttgttggtctatactgagatgatgctacatacacagaatcatagggtagatatagtctctgacatctgcacagaatacattggataaaaaaaatcttaaactcaaggattgaggattaccatcacccctttgtgatttatcataggctcagattatccagcataaacccctatagtttcctctttgctggcaacccttgaaatgcacaaatccctttgtttccccacagtgtaactattgcacatgtatttgctcagtttttggctgttgtcacatattttataaaccattcgtcattaaggacagtctctcttggagtgtaaactcccaaatctggaaaaactgtgtctcgtttgcatgacttctgcagtatttagcatagaatatgagaatctctgggaatttataaaagagactttagttgacatggaatattatattgtttattgactacaccagttttcctgttggtttagccatctctctgattggaaagttcttttgctttttggagagggctttattattttattttctcaaaaagggaatgaatatttttagacttcctggaacttgttagatacacatgttgcctgggcctttgcaggagcctcacaggttgaaatgaacctaaatcaaacctttccctcttggacttcatgaatgatgatagacattgactgtcttactttttatcttgcaggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatggtatgttattcaagtcatatgtaagaaccggcagttaggtctgtactgtagctttttcacagctcctctgctccctcagtgcttaagttttctcccaagatgttgtccttgttggataccagagacgagtttaccctgtagctttatggctagaatacttccggatgcactggaatctgtatggtaggcattatggaaatatggtcacaaggagacaaaaaatagattagtttaacttaaatgctttgatttattttcttgggtgaacacagaatagtgttgttgacgcaagtccctttaaaaaaaaaaagacctcataataaaaagcaggcatctgaaaactgtcttagtcaaaataaagagaatttacagatgctggacttcaaattaaatttcaaaatggatccccaaagacaactagaattcctaaaagttttgcagaacacaggcaggattaaagttcttgagtttccatgcagcagagacccaaaagtagccattttactatagtcttcattaagctgggctccatccaacctcacattagctgaagctctggcatagtctttccatgtaaaagccacgacagaacccattctaatcacctatgccagacgtggcttcttgcaggcacactttctcttaatattgaagaaatagccaatatgagccaattgaaagtgtactttgatcctatctgaacaatggtacagataacagactttaaaaaatagaatatggagtccaaaacacctcaggattcttttccctggtgctgttcactcagtttgaagatttttatgaagtagatttagttttaagaggattgatttcctttgtgcctgttttaaaggccattctaattacatagtacctttgaagcatgcttttcttgacattatgtgtggtgaagaagtacaagacaaattttctagatatgaaatgtctttgagtatttctgcaaagggcttgttaccatggtgagaaagttagactaaattagatttgatatagctgataaggcagtcctcagttaaagaacaggttgtatttcaaatgttggctttgagatgtgttatttcaaacttataaccaatttaataagtgttaggttcccaggtgagaccacaaaagcatatttaatctataatgtagttgaactaaaacactgtctatgtagtatgccgttgatcctacccattttttcaaacacgctatgtgcaaaattatgtcttagttctatcacctttccctggatgaatgggaacaatttatatatctgtatatccttcttattacccatatccccctacatatatgctgtagctgttaaaagtatttaacaatatgttaataccatgtgaaaatgggtgttattggcaaaatctatcattagacctcctctgtctctcctgatcactgaattattattattgaaaagaatggtgttttcctgaccatggcatttctcattcaagataataacctaagccttttcttttactttggggagaaaacttagaaagctaattaaatggtcatttttgaaaacttaagatgttgatatttaaaaatcaccacttaggggcttcataatggaatttagaaggaaaaaaaaatctgctctttagaaatgactctcccgttggcagcacaatgtagtggagataaagttgtttccaagttccaaggccttctactgcaagtcacctcatttcttgttagacttgtatcttcctggcagggagcccacagtcattgcctatgggcctactggtttagctattcttttcccttctcgctccccatggttttatagcactactatgattccaatgtgtagtgttttgttgttgttgttgttttcttcttaaaccatacagagaaactttatcagtaagtgttaacatgtgttttttaaaaaggatagaaagtttttcttgctcttccctaccaggcttcacattcaataaatatgttaacactgtgccttgatcagtttcaaaactttaatgattatgaaactccagtgttttttctgacttcaaattaaaatatggcataggctgggcatggtggttcatgcctgtaatcccagcactttgggaggccacggcgggcagattgcttgagcccaggagttcgagaccagcctgagcaatgtggtgaaaccctgtctctactaaaaatatgaaaattagccaggagtggtggtgtgcgcctatggtcccagctacttgagaggttgaggtgagaggatcacttgagcctgggagttcaaggctgcagtgagccaagattgcgccactgcactccagcctaggcaacagaacaagaccctgtctcaaaacaaataaataaaataatataatataacataaaatatggcatagacaataaagttagggaacatagatacaaggtttttttttaatgggtagtagctgaaatgtacttgatctggagatcaatatactggaatgctggaatactggaatgccagaatactttgcacattttctccatgttaggttacagaaacaatgagataattttatatggtaaaaccttagttgactggtacccaccaaatcatagtcccctagtgggtgctgcattgattgattaattttttgtttgtttgttttgagatggagccttgctctgttgtccaggctggagtgcagtggcgcaatctcggctcactgcaacctctgcctcctgggttcaagcgattctcctgtctcagcctcccaagtagctgggattacaggaacacaccaccacgcccagctaatttttgtatttttagtagagacggggtttcaccatgttggccaggctagtctcgaactcctgacctcaggtgatccgcccacctcagcctcccaaagtgctgggattacaggcatgagccaccgcgcctggcgatgattgactaatttttaaggctgtcaattaggacttgccagtaattctcaatgcctgccgatccaagggcattgattaacaggctataggatatgtcttgactctcagaaattcaagggtggatgctttggccaaagaattatccaaactattataatagctaaaccctggctcttggtgtgaattgaagagagaaagttgggcagactaaaaagatggtggtagggaaccaagatggagcagtgaagttgcacagagacagctggggacatatagtaaggaaatagtaaaaggacacatggaaatattatgggtcaggcaacttcaagggagtaccttttgtcatctgcaagcttacagtgtaaattcaaagtggtgaccttgaccccagacaactttgtctatcatcaaaacctgtctatgtctatgagataccacttctttctaaggtagaaataattacttttaaagtaattattgaaaaaaaaccttttcaacaaaaataaagtttgggggcttgtagagagttagccttctgttaccagaaatcatctcattatcccagttttccatcattcttcctcaattgaccctggtcagggttctagtgccagttctgacatttttatagtcattggatttgagagatgagtcccttctccagttcccttacctctaaggcccttttttattctgtacttttaatttcctatcgtttgcacatctcaagagactgtacggtctatatcagtttttaagatataaactcgtgtgtgtgcgtgtgtgtgtgtgtatgtgtgtgtgtgttcggatttgggtgacgtacaagagaacacttcctccccctcaaaaatcatcagatttcttatattttaaatctatatcactgagtttaaagactggcctctgtgtttttctatgctatcattttttaaacccactttttaacttaggatgtttaataccagaaatctgtattctgctggagacatagagccagattgtggtagtgacagagctagctgctccccctcttggccaattctgggaattttttgatagtagagctgctaattaacttagctgaatcagtcatctcatgaatatgctaatcacatacttaattcaggagggagttagggaaaattgcttggcaaagggaatagaaatagaagtggggcataatccgtgttttgggaccacagcataaagacccgcccccaaatgcctggcattttgtgagaaaatagttgtttttaaaagaagcatagttaaaatcccaaataggttaaggtgattacagctgccatgttaaatgtatttctgaattacatagtaaaaatgatgttacagctatgaagtaatgtcattgctacataactgcctgtatcaaactgtagatattctgcatgtttaaataactaaggaaatggttgttgtctgatgctagtctattgggaaaactcctttaatttgtcattttcagagcaaatttaataactttggatgggaggcagtgcacagtgaattatcatcctagttctgcagtgaacccactgtgactgtgacctggggcaattaaatgagtctcagttttcccatccataaaatgagggggttgagctagatgctctctaaaacccttttcaatcctaccaattctgtgaatcttttaaacatgtgactagaccagctgctttagtgaaaggccttacaagatgttaattagccgtctgtatggtaccctctattttccctctatcattttttaactctcagctactttcaccaggtctttgaaaaaccctcccatgagcctgaagcttgttaacttgaataatagtagaaattttctgaattagcttaaaatgcacacaaaagaaataattgtctgtcccatctatctgcatgggccaagtgtaaaccaagcagttacccttcccttaagccctaaggccccttgtttcctatcacttcacagaggcagggcacgaagcactcttcagacttagcagaatctgcattttaatcaccaactgcaaattttctgtagttcatattagccattaaccagtgcagaggatcagtgagtaggaggcattaaaatttatatgcccgtgaaaggcatgacctcagtggaagcgagctatctgctaaccttaaaagacaaatatgtccagataagcttcatggccattgactaagctgaaatttctggaattttcctgacccctgactttaactattttctacctatatagataattgtcgtttatatagccacacttactaaagatcccctgagagggttttacattggaaaaagtctaaaacaccctcaaagtaagtgtgtcatagatatgcatagcataatatacaacattgattggtttttaatcctcacctcacatttcattaagacattaaaaaaatcattgctttctaaaacctctgctgtagtacagcgggcaacatttcataggctgagtagcctcgaaagtacggagaaagacatgaggccttctggccttcctgcaaatgcagtgtttcttccagattatgccagtggtctccgatttagtttgaaagcactgctactctttcctttatgattctattttcttttctttccatatgaaagagactaaaaagccagctacttttgctaattcttttataatctctctgtgaaacttgaccagaatgagccactgccagcttactgtaatcaaatcaaaagctcagacaaaatgcacacatttctctattgacaaaggttttctgccttttgagttgttatctgaagtgtgaccaattgtgactttagcattggctatctcatcggattgaaaatgcatgtgcagctttacgagcccaaagcactttaactttgggcctctcctcttagctttgacttcttcagaaggcatgacatcagcaagaagcaatggatctgtctggagggaagtaaatacatagaagagcttcagatgaactgcttttatcaactctgttggttcattgctctttgggcctgggagtttggaatgttgttcatcactgcctgctctacttctatgtgtctgtctgtccaggcaaagaacagggcttagttgatctagcactgactccaaccgattgattgagagaattccctgtgcaggcaggcttcagccctttcttgttcattgtccacacccatcttcatcaccctctctcgaaagaattagcagagcaatggaaactcttgtaataaatatgactctaacagcaaggatggtacatggacacaccctttctgcagatagatttggcagtgtgtcagcagttttgaatatgttcatactcattgatttagtaattccacttctggatgtgcatcccaaggaaagaaagatctgcataaacacttatgtacgatgttaataggatgttcatcacagcattatttctagtggtaggaaattggaaataagcttgcatgccccacaatgattacactattctccgtccatgtggtgtcattgtatgcagccattaaaaatgatggttctgctgggtgcagtggctcacgcctgtcatcctagcagtttgggaggccaaaatgggtggatcacttgaggtcaggagtttgagacgagcctggccaacatggtgaaacaccatctctactaaaatacaaaaattagccagatgtggtggtgcacgcctgtaatcccagctactcgggaggctgaggcaggagactcacttgaaccagagaggtggagattgcagtgatttgagattgcaccactgcactccagcctgggtgacagagcaagactctgtctcgaaaaaaaaaatgatgcttctgaagaagttttaatcacatagaaaatgctaaccatatagtgttacataagaacacggtgtaaatacattttatttcaaccacgtagcaacatgtatttcataggaaaaagggaggaaggaaatttgataagccattgttactgtcttttagcagtggggattatatttatattttcttcttacctgtccatatttttcaagttgctataatgaggaatactatttaggaaaaaattatatatttctttatgaaaaatatggaaactgctttggtgaagttttaaaataatgtttttctttttattaagtattacagtgctcactgtagaaaatttggaaaagtagaaaaatacatcaaatcctccagtggttaaatagaatgaagggaataaagggaaatagttacttttgaaagcatgaaggtatatcacttttctgattataaaatgtcactgaaatatctgggggaacaaaatcaagaaagatagaatgaaaaaaattacccttgatccccagcacccaaccgtcactcttgtatttacctaatctttttgtgtacgtagataatgcatatacatacatgcaaattggtatcataatgatttgctatttcatgttctgaattttttttttttttttagacagtctcactctgttggccaggctggagtgcagtggctcaatcttggctcacttcaaccacttcaagtgattctcatgcctcagcctcccaagtagctgtgattaaaggctcatgccaccacacctggctaatttttgtatttttagtagagacagagtttcaccatattggtcaggctggtctcgaactcctgacctcaggtgatctgcccaccttggcctctcaaagtgctgggatgacaggcgtgagccactgtgcctggcctgatttttctcttgacattagattattaacagatagactctattatgagatgtgtgtttgaagctatatggtacctctctgactgatccacatagaggttagtacatggaacacttgcaatggctcctccagctccctagcttacttatacgtgtctgaaaccttctctgggcatttccgaatgcacagaactctgggcatgctaaagccaattgcctagctggtactgagagtgcccttagtagaaatggaatgatgcccagcaaaagggaccttacaatactgagcctgtgtccctggccacattagccaaagatgggggccatcagtaaacattgtatttattcccttggagccttagcattcaaaatgtgttcacgaataaaagcaactttgggaagaaaggctgatcttattttggcagaatcccctagtactctgtgatatgctaatagctcctaataagagctacagctggtgattggcctgtccaccaaggagcagcctgttttttgtttgtttgtttgttcgtttgtttgttttgcttagacttagggtctcactctgttgcccaggctggagtgcagtggtgtaatcatagctcactgcagcctgaactcctgggcttaagcgattctcccatctcagcctccctagtagctaggactacaggcatgcagcaccatgcctggctaagtttttaaatttttgtagagatggggtctcacttttcagggtagtctaaaactcctagcttcaagcagtcctcccgccttgggctcctaaagttttgggattacaggtgtgagctgctgcacctggccaaggagcagcatattgatttgctatcaattgataaacataagttgagtatatgatcttttggtacactagccttagcaggtactctttagaagagtgagattatgccgtgctcgagaaaaaaatgcctgtttaaaaaaacaaacaaaaaaacatatgcagactttatcaaaaaagcaaaacaggaggagatagtgataaatcaaatttcaggttgtcagtaaaatgcttgatgcttttcctttttttccttacatttttatatgcttatgtttgctgttcttcattaattacttgatcttaggtgaaagagtcgatgggtgtaactctttaaattttcttagaagtttgaaaggtatgatttgtagcatttacaaggaggcttcttttttcagcacttctgttgatctagtaacttaatgtttgcatgccacaccaggggtatgaaatacagcatttatagtaagagaaaaatcaatccttatatgtaaaaggcagcttcctaataatgtaaataccaggtggtaatttatagcaccaaaaaaaatggatcaaatgaaaagggccccaatctcttaaggttatgggttaattctagaatgcattaatcaatagccagttgattgtttataaaggagtaactaatgtggcatttagtagcagaactggaggttctttggcctatttcaagaattttgaatgtttatttgatgcaagacaagtagctggggatagaagttccagaagtacatggtgttcttctcttttttaaaagacaggatatttacatagaaaacatttatatggaaaagttttgtcttttcactctagtttttcccatgttaaattagtactacttgcatttagaatgattagattttagaactggaaagtacttacacttccctagctcaatccttataccaagtggacttctggcaaagaaggtagtatgcaaatgaaatacatgggtggggggtgtcgacctgctgatttattcttattttttatatgtgtgtggtgtgtgtatggtattctcttgtttaatgtaatgtaagctctcttctcaagggtgaggtttccccattccctatttttcacccagcagtcactcccaccctcatagatgtctgggacgtttcacaacctttaaaggtagaaccattaagcatttcccttaggataaacagttcccaattttataaggccttgcgtcttcttagaagacctccagcagctttggcttcatttatgtcccctcagatggataatgtttgactccactaggaaagataaaaaccagtctttaaagattttttttaaaggattgtagatacaaagaaactctaagagtgacaacactatcatctcacatattagtaataatgtttatttgttgagcatctactttatgccaagcattatccatatgaggtgagtgataatagccccattttatggatgggataaaagaggctcagagagattaggccttttgcccaagcaaggtcatacagtccccaaatgagagatctcctgtttttcccactgtgtcctcctgctttagattcatagcatgttacagtgtttatttccatcctgtgttgagtggccattcatgagctcaaggagtagcagctgctttatctttagaatgtatatacttaagccttcaaactgaaaattgaaggggaaataaacgctgatcacagacactatatttcaaatccttgcaaaccaccacctctcaaactttctttcagacaccagtagctttacttaaaacagattccctgagcagcatttttacatgaatacaagcaattgctgcacagatctaacttccaatttgcttggcttttgatcgttgtggaatcctggtttacattgctcttggctggttctctcttagtcaccaagtgtattgtaattagtttcaggcataatgattatgagcaatgattgctaggtgtctagggcctgtacagctcttcttcagcagttaagatctgaccctgattctgagttctgagaatgattgaaaaaaaaatggagatgaacattgcagcgattactgaagttgctattgatggctgtggaccaggatctgaatggctaatttatgcttcattcctcattgtagaagtaaatgtcatgggaatagaaaggaggattggggatgtgaaagaattatgcaagaacatgcgagctgctagtttaataggaggaacagatgcaaaaggattttttctccttctttctaatagcaaattattatgctttggttgatattgtacccaattgctatggattttagaatttaaatgatgtctgccatccttatgaggtccctttgaggcaaaaggcataggtagaatagtcccaagcaacagggctagtaagaatccatctaaaaagaaatgagtctgggtcttctggatcccctgatttttgtctggttgactctcatagattaaatatatgaatatttaggaactttttgtatgtagtgagggattaacaattttatagatgtttaaaaaaatctctggtattctcataaaaccgtatgtggagagtggcagtgtatggtaaaggtgaattggatgggggaaatttgtcttaccagaaattttcattatggtctgattgtgcaagaagaaggttaagatgcatggcaaaacaccatgtgctttgatttgagcccataagagccactcagtacatacttgtcaaattgcatacccatttggagaaattatgacgttttaactcattattatcagttttatagaatttctcaagcatttattaaccatatgctcacccaaatggtcttcatatttgcaacttatatagccacattaaagagtcttttaaaatgtgaaggaaagaaaataaattttctgaatgatgaaatgaattaggatttagtatgtatatagcaccaacctaggctcttaaagtacacgctagcataaacacacacacacacacacacacacacacacacacacacacacacacacactttcctggacagaatgtgagtcatggaaaccaaagtatggtccatggtgggtgtcggacaggggcatgtcagtttcaaatcattctcctcttcattaggccatttctcttgtactccaaagtagctatgttatatatggctgcatccacccataagctcttgacctgaatgaggaactccaagattgataatattttactttttctgtaaagtgttcagtgatttagtgtttgtttgacttgcagcactttgtcaaaaggctaaactttgacatttattagaagttttaaattaaaactaagcttgaaatgtcacaccgcacctcgccccacccctaaaaaccaacatgactctaggtgacgttccttaaaaatgcaagtgagttttgagaattacttactaaatgagtctgaaagcacaactcaaataattctgaatgtccaatttctgctgatatgtgccaattttatgagcaatataataaaaattcaatataaggaaggacatgtggtagctgttggaatccactctttttggtcatgaaatattaatagcactggattgacacacaaggcttgcatattgttctcaatgatggcaaagctttgtttttccaatatgtgatagctatgtgtgcaacacactggtcatataataacgcaatccacgtgtgccttttatgccctccatgagcaatcaccacttggcaaggatgctagcaaaattcaagcatggtgtgggacatggaccagatgacatttaaggtcccttctcaactttgaactctagaaaagtactgcatacatttaatcatctatgttaacacttagttgagagagttccacacaagaaaatttgtccccaagacaataaaaaagtcattcctaggaatgcaataaatttatttaaaaacacaattcattggaaagacattttctcttaattaaaacattaatgcttgtcctgactgcttcatactcaacacagcccctgagttgttggtgattgcaactgataggtgaaatgggagaagtttcagcagctagagcagttgttttccaactttagggtatatcagaatcacagatagctgaaaattttggcctgtccaccaagccatttggcctgtggacaagtcagttggctagctggtgctgagagtgcccatagtaaaaatggaatgatgcccagcaaaagggaccctccagggtttctgattcagtaactctggggtggggccaagaatttgcatttatagcaagtgtccaagtgatgctgatcctgctggtcccaggcccacactttgagaaccactcaggggattttggagaaaataaaaggccatcccaggtagctgattggtatgcttcttatattgttcacctaactctttgtgcagtttctgccctctcactttcagggagagagctttggtaaaaatgtcaggctgcacacttgtaatggggatgagttgacctgcctatttgtttactatgcagaggaagtccatttccctttctttctctgaagaaagcccagtaaataaaaggcaagcaatagaagggaaaagaactagataaaaggaaaaggagagaagcaaagaaaaaaaaaaaacacaagccatacctacaatgtttgaaaagctggaaccagggaggactgtggacttcatcctcaggcctcaaggaataactaagtgatgagttaggggctgagagacataggtatagaatctcttggcatgtcaggagagtcacacacatacatctccctgcaaaagtattcagtttcctcagtccaggttttgaaaagctatttggtattagtggccagtctctgagttgcccacccaatgtgagaagagaatggttttgtagaactattgcattttgataagctcaccaatgttctggctttgaagtaggtgtcatattttcttttctgttccatatttactcagaggcagtttcttatttgatgtggtccttatattttgctttggtatttgttatatttcctgcttataaacttgatatcatgaggtgtttatttttataccaggcaagagattctttaagaatgattaatgttacaaatacacttttggcttgttttttcattgaagttcctgaggaaagcttcagaagaaaactagtttgccatttgtagttaagagattaaaatctctaaccttaggctgtggctgtatggtggccaaaaagtaaatctgaaataaccaggtattctcatttacatttttcagtttttttcatgttgtctcataaatatgctatatttattattaagtccattatgcatgtgctctctctctctctgtctctctctctcacacacacacactcacacacacactatcagaaggaacattgaaaagagtctcatgatgttattgtataaatcctttagaaacccaggatcaagctggatactcccaatttgtactactgtcacagagaaacacccaggaacttattttcagaaaacttatgtgcttgcttgtaggggtgtttgattatgttttttggcctcaaccattttccaggcagctatagtgcatgatcatatagataagtgaaaaggagaaatgaaaaaaaaattcaggcccaagtaaaataacgacttttgaaaacacctgtcctgctcttaggttacaattagaaggcatggttaactttggcttagattcttaagtaaaaagttgagggaaatctcatgttttagacttcatgtgcacattttttccagtttttctttattcacctatgacagagagaaagtgagagagagaatgagagcatgtgtgtattgtactgactcctgagaagctgttggtttaaattttcatttttttcctctctcagacacctatgtaagtgactttgtgacacagctttcctttcattggcaaatgatctgagatgccacattccccaaaagaaattcaccctatatacaaacacgttttccaatttaattgtgttttttttccagttttcaaatttactggaaaagcagttatttaaacactgaaaactctcgtttttcctttttttttttttttttttggtgttggtttcagaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaagtactccttgtcttctctgttttgtttttgttttgttttctttcatgttaaaagaatgtttgggaaaggtagaaaaataaatcaccaaaattctgttggttcaatggcagccttttcttcctctcttacctcttctctcccacacactgtccttacacgtgtacattttagagttactaaacaatactgtgatcagaatcttcacctatcattattattgtggggtttttttgtagctattcttagaagggggaatatatgtttactcaggaatcttaatttttaaagtaggttaatactgccatacccattttagctcttattctacttcctttctgcacaaacaaacatacacacacaggctccacatttggttgttttgtgtgactgtcagcctactagtcatagtctaggaaagcatttaatctctgtgagcatatgtttccttgttagaaagtgtactcagagctctttggaagacaggtttctacgacaattagtgtggactacactgctgttgactcatgactctgcagaattaccaatacagaaagtgaaattgtagtatgtgatcaggagctgatgaaatgaacctgtttcctcattgggaaattcagcgaattggactagatagactgtgttctttttttttgggaggtggggacagggtcttgttctgctgcccaggccagagtgcagtggcaggatctcggctcacttgcaacctccacctccggggctcaagcaattctcctgcctcagcctccctagtagctgggattgcaggcgtgtgccagcacgcctggctaattttttgtatttgtagtagagacggggtttcaccatgttgttcaggctggtctcgaactcctggcctcaaatgattcacctgtcttggcctctcagagtgctgggattacaggtgagagccaccatgcctggccgatagactctgttcttgagcaggatattgctttaggggcctcattgagcagaagcaacagagaaggaagtcttttgtgggtgagaccgtgcaactgtgcctttatctcccagttccaccagagaatctttgctttctttgacttcacacagcagggatctgagcaagatttcaaggggaaaggggttccactgctccttcactgccactcccctcccccaaatgaaatctgaaaacttcttgaagaccccaccacctctacctttccatgagtcaataccagggaagaaacataaatatactggggcaaagtgatctttgcaaggctgatcttagtgctgtcaactttaggccctcaaagggaaagccaaattgtaggccattgctaaaaagcctggatgcacaacaacagcagattctgctgaggccatttggttgttttgaggactggaagaatggacagcataaaaactggacagcactacaaacatgaaaatagacacctgattgcctctcacagtttatctacagttagggtgaccatataattttttatccaaacaggacacttactgtctaaatcgggaggtgcttattaacaaattattcacagacaacaggtgtcactttttttttttttgatagagtctcactctgtcgcccaggcttgagtgcagtggcgagatctccgctcactgcaacctccacttcccaggctcagacgacaacaggtgtcactaattttttttttttttttttggaatctcgctctgtcacccaggcttgagtgcagtggcgagatctctgctcaccgcaacctccacctcccaggctcagacgattctcctgcctcagcctccctagtagctgggattacaggcatgtgccaccacactcagctaatttttgtatttttagtagagatggggtttcaccatgttggccaggctggtcttgaactcctgacctcaggtgatctgactgcctctgcctcccaaagtgctgggattacaggcatgagccaccgtgctggccaggtgtcactaattgttagtaagcaaccaggactgtcgtggactggccaggatacacgggtcactctagttggagagaaaacttatattcaccagagtgaggataaagattctaaagaatggtttattatgaaaaataggtgctcatgggatttttcatattagaattgggtgataataaggattaattgattgattgcattcattatgttgtttgttctctctctcatctccaggccataaactgtcaggaaacaattctttctagtatgtttttgttcactccttctttgatattttcatcgtaaattgcaaatatttattggggcatatgagggtggagttgagggtaagtggggagatgattgttataattaaaggaataatatctgattcttgaacttctgccaaccccagcaaccattattaatcttggacatacttttgtcagagtccctaaaacagtgcacagtgaatcagatcaaagttatttgcattgtggtacacccagcacatttgccctccttcaacaattcctcatgttcatcctccactgaaagggcagaaagacactgctgtgtgatttggacatctgtgcatgcatgtgcatgtgcgtgtacacttgtgccaaagagaaagagagtcaagagccctttgctagtttgaaaagtactttctttatgttaaccctctccccttcctttgagtttcagtgttgattcttggagaaaaagggccagacagcagactcaagcctgccttggtgttagcctcactttgcaaggttggagctattttagagaactgaacctacaaacatggatggggagggtagccaaactgagaagtttagagacaattgattgcaggttagaggattgaaggctagaaaaggcttgcctttgttctgcgtctccctacctcccaggttacggggaagtaagcagttgtgccttccctgtgttgcattcttctggacgtcgttctcagaattaaccatgggaaaccaagaagcttgactttgatatttaagattcagacacccttacttatgcaacaaaggtatgtgacccaatgtgaaatagtcacaatcactttttctttctcctttcttttttaaaagaggcaggatcttgctctttcacccaggctggagcgcagtggcacaatcatagctcactgcagccttgatctcctgggctccagcaatcctcctgcctcagcctcccgagtgagtagctgggaccacaggcatgcgccatcatgcctgggtaatttttgggtttttgttgttgttgttggttggttgtttgttttttgtagagacagagtcgcgctgtgttgctcaggctggtcttgaactcctggcctcaagcgatcctcccacctcagcttcccaaagcactgggattacagacaatcactttctgatgttgcttttggtgtgaatttttcttaatagaaaaaaaaagatcccctgtctaccttagtattgttaaattctttgagaaatttacttttttttttttttttttttttgagacagagttttgctcttgctgcccaggctggagtgcaatggcgcaatctcgactcactgcaacctccatctcctgggttcaagcagttctcctgcctcagcctcccaagtagctgggattacaggcatgcgcccatacccgactaattttgtatttttagtagagatggggtttctccatgttggtcaggttagtcttgaactcccgacctcaggtgattcgcccacctcggcctcccaaagtgctggaattataggcatgagccaccacatctggccttgagaaatttactttctaaatataaccctaacaatttttgtttttagacttgatctctattctatagtcattgtattctcatgttagcctaagagataattgtgtagttgtatgggaagaccgtgaataggagcaatatgcctgaatttacatagagtgaaacataacttgccaattgtttagctgaaaataaagttttgtggctactttaagtattgtggtcacaattgggaatgcctaaaaaagacaatgtttttgctttacaactgagcttctaaatttaaggactgacttgaaatcaaaccctttaattaaattaattatattatctaaatgaataaagcatataggcatcaagtcagtttctaaaggcgctgaaacaagaattctataaatatctaccatctgtggaatgcatctgcatacaagcatgcaaggcatacttgcatacctgagaaaatatttattacattaatttttggagtatgacagccagttaaaaaatttgagatacagtggtattggaaagacaataaaggatctggctatcaaaaacagttcaaaatgaacatgttgaaaaattcatttgattaatttataaataagattctctaccagtttggatacccaagtaatgttttttatatatatgggttcccacctctgctaactcctgcccaagaagcacagtttgcaggtggatctagaacaacccaagaaatgaacatttcttcttttggtgcccagtaatattaattgcttcgggcctgaaaaaaagacctttcaaagtaagggatgtgttccctaattgaagagagccaccccatcagccacctcgtctacaaagaggtctttctttctttccttctttcttttttttttttttttttttttttttttgacatagggtcttgctctgtcacccaggctggagtgcagtggcgtgatcatggctcactgcagcctcaatctctgggactgaagcaatcctcctgcctcagcctcccaaatagctagcactacaggcacgtgccaccacacccagctaattttttattttttgtagagatgggggtctcgttatgttgcccaggctggtctcgaattcctgggctcaagtgatcctctcaccttagcttcccaaagtgctgggattacaggcataagccactgcgcccggcctacaaagaggtctttaaagtgaaatatgaaaagcatcatggtcttgtttgcatacttagagatgttcccactttctcttcgtgagtggatgtccagtttacttttgcagcaaaggggttgcagttaaaagttgagcaatgatttgattatcactgaacctttgcaaggccattagcaccagcaagcttaagttacttcaagagaaagacacttcatagttgaagtacacttgccttgcttttgttttttctgggcccacatctccagtgatttcagctcactccattgagctttacaattcaaacttcccaaaagcccctttaattagtaacaggtggttcaagagtaccctcgtactacacatctttgtattacttattccatcgttatttgtcatggttcatgatacatttcttatttacctgcttgtagcagcagttttgcctggaaggatgaagtctgttgtggtctttcagaaatgcacaagtggttacatgcatcatgaaaattaatagctcctatgccaaagagagttgcattctcatggtttcagttaacactgacataatgggactatgtctacacctacaccccaccccaaactacagaagctataattagaaatcagtgcctcaccattgggatgtctaaatgactgtcctgccttgaaaacaattttcattgctccctctttatttctatttgccttagttttgcatctccccacctcccaggttaaggggatgtaagcagttgtgccttccccgtgttgcattcttctggacatcattctcagaattaactgtgggaaaccaagaagcctacaagagtactaaacaaactattttaccacttcccaaaatcattataaatacaaatttaaaaaatagtcaatacaaaaagcttttaagaagcaaagtgtagacacatattcaactctcaatattctttttcactcacaatattaaaatctagaattgcaaagaggaagatgggactcaagctatggagtggggaaggggtgaggatggtaggagtacaggaggtgtcaaattgaatacattgagtttacatactcacaaaacaaaaatagagcccttttcaagggggttgacttataagtgttaactgagtctaatcatttgaaacaaagacaagacacatttcaagtatttatgaagcttcaattttatctacaacatctccagaaatattcctgactgaatattttgttatgctttttagattttgttattagaggaatcattaggaacttctcatcctcctttctttgtgtatatgcattgaattcaaaactggttaggaaattgttgaagaaactcatcacatcccatggcaagtgtgggttccctatcactcttaccgtaattctgggaatagttctgttatttctattgggtgcttttgttaccaagcaacagataaaatctagaccttttctgcttgcttgctactattggctgtgcaaaaaacaaaaacaaaaaaatagtgcaatgaatgtatgttaggaggtgaaataaactaaaaggaaatgcatttctagcttcagtacagcgtgttgactgtcatcactgtgtaatgtggcttaaggctcgttctgaattactgaaatgaaatccaggctgtgtgaagagttctgttccagcattttttttttcaggctgcttgcagtagtttttaatgtggtgtttggaaaatgcaggttattgggtagaaagtctcaatgtatatgaaaagagtctttgcagaaaaggctttttatagcagatatggcatgcagatgtcatgataaatgtatatatcctgaggaaggcaggaatgagtatttttaaaagagttttaataagttgagaaggaaatgaggcatcttcccccccacatacacactgacttttatcatgaaacatagattggctcctaaaatcttaaattttaaggtacctcctacagttaccttatcattaagaaagacctctgtcagtcttgaaggattttataggcttggaaatttggtatcaatgtattgtcattatgggtcaataactcagattgattttgatatatgagttaatatggaagtactcagtccagatgatattccctttctatcataccaccccacaaaagcaaatgaagcaaacctaattcttatgtaaataatgtagaaatctttttatttttatgcacattacgtaccgttttatagtaggaattgatcatctctgctacattagtatagttctttcaaaacattaaaattggtaaaatatgtaattgttttctggttggttttgttcaagtgaacttttttctcttcacatccagcagtgttttcttgagcctttgaattctttgtgagcagggactgatgagtaatacacatatattcatatcatttttctcacctgcggcaccttgaatagttctaaatacatagcactggctcagtaagtcattattgttttactaaacaatgttatctcatccaagtatctagtgagatattgctccatgtagaacagttgcatcctaaattaccctccaacataaaaattgattcatttggtcaataaacattgaaaactgaaaattgtcactagaaaacatccagctccatagtggagtgtacattgtacatggagatactgtactagttctaggagctctggtgaaaggattaggcttatgtactgccatcaaggttcctatagtctgttactcaaaagaagccatttaggtacatagcatggaagtcaagtacacctactctggaaccaaattgcctagattcaaatcctggtttggccatttactggaagaccttgtgtgagtcccttaatctctttggggctccacttcctcatctgtgaaatgagataatactcatgttatgtgattattttgaggcttaaatgagttaatacatgtagagtactgagaatagaacctggcacatactaaatactgtgtaaatgtatcatagaaaccaataaaatccagtaaaatctatcagtagtaactctgccatagaacagaaaaattttctcttgaatcttgacatcaaaaccctcatgaccacgaaaccataaaagctaaataagcattttctttaagagatcattaaaccattctttttatttaaagggggaagggaggagtgtacagtttttcttttcccatttcttcatatgattttaataaataactattaaatcattaagagaggtctgaaaaatgtgactttcgtaaaaagtagtcataactcctacccctgctcttaccccagccccaaggattctggaacttactaatatctaggctcaaccaacccttctaaataaaagaaaaaaacatatcaaatgttagtcaagagctgtgccccaaggtagcaatcaaattgaacaatttaagtggcacaccatgccatgccatggagaataaatacataactgaagattaaaggaagaccttttcgttaatccctgtgtggcatgatctactgcttggttttgggtcttacggaataaatctacttcagcaaataagttttggaagactcaaaagaagtaattgattttgagggttaccagggagtagaatgttgaatgaacttgaatttctattcaaaatgaataaagccccagaacaaagtctgacttagtccactgttatgtttgcttaagggtgagagatttgcccctaatagtgtggagagaccattgagagctaatgaaagagcccccagcagtgcctggtatattaccatgtgacagtaagtgccaccactggatccagaagatcttggactttcaccagaagctccacgagagaacttaaattaaagttgcagattgaacatgccaaatctgaaaatttaagatccgaaatgctctaaatctgaaactttttgaataccaacctgatgcttaaagaaatgctcactggagcatttcagattttgggtgttcggtttagggatgctcaaaccataattataatgcaaatattccaaaatccaaaaaaaaaaaaaaacccaaacacttcttgtcccaagcacttttgataaaggctactcaacatgtgccatatactgtgtagctttttcttccatggtggtggcatacttttggctcttaaagactccaaaagagaggcaaccattttgtttactcactagggtagtccagagtccttgacactctgggctcactgttctgagcctgggcaggtcgacaagggtggggaccaaaggcctgggcagtgctagcattattgctgtttcttctagggggatgagactttgcaggggagacctgtttctttaggtctcgtgactgttttaaaactcttccctttatattagggcctcatcccactaaaacggatttgcttcccagattctgaattcccttcatgtgaaatagtgcatggtggtctgactagtggttatgagacaaaagacagattttttttcctaactttgatattttatatgtcctttctctttccatttttcttataacttcctcatctctcttttcagttctggtattatttagtgtttccctagcatgttgtagctgagttgcctgtgaccatttttagtagttacacaacaaatcatgtacagagcatgagccagcacttagccaaataatgaaatggaagaactctgccaaactcagcatcataatttcccttaataaaactctactgtgtcatttagtttggtctctttttaaaacttgagcctccatcagcctattttaggggagggtactacaaggtctgttgcataaatgatttgacttgcaattgaactaagaatacaatgaaccacttcctagagttattttttaaaagaatgagaaaggacttctttgaaaaaagaagtgttttctgaatataactattttgggtctaaaatttttgctcatttcctaaagtcctgtaccacattggaattgctttgtattttgtagaacaggttttgtattctaatatagaaattcttaacttgccttgttacctaaattcaaatgcattccagaataatccctggcacatagtaggtgctcagtaactatttgttgaccccttagctttctacgtttcttcttacgagggcattgtctcctcttaagcataatattcaacaaatgccacgtgctattcagtgatttttcatttcatagccacttgcataacttttacctctttaaaatctagccattttgcagtctcatcaatgtggaacccaactaaaactaaagtaggaaataaccagtgcctaagattacagtttcctgtcatctggcagggaaacgtgatacatctgggaaatcttttcatcacaaatgcttgataaggtatagtactggaatccgatgttgtgaggtgactgtcagcaagttgcttaatctctttggctttggcttggtttttcttatctatcaaatgtgagagcaacactcagtgatctctctggtcccttccaactctaagacttctgtgatcctatgcttctcaggccacctcccccctccagtcctgtttgctcctttacaaaaggagagggggacatgtagggaagtcttaacaatctgtgactttaaaggaatgaactttcagctgtccagcaaatctggctatccagaaaaggccattcctccagggtatattggttagccaaaattttactgtacattaatacatagttaggactaatttagtgcctaggaaaacatttgggaatggttaaaactgtggaaaaatcttaattcttggtagggcagtgtatacaattaccattttattgttacacgtattccccccttttaggctagagccttgtttgggatgaggggaatggatgtgcacatgcatcacgtaggagcctgactgttttttttctcctgacaccactaatcccctgttcctgttcctaagggcactgctgataagtgatatccaaagtaacactccagagcaggtgaagtgcattgccgggctgccctgcatcccagcatctcttccctgtggtggtatctgcctccaaaagtctgtgttagcagaactggtgggtacttacacagaagaatgcactaatcctctgatactgactccaaaagaggagggtggggcagagagaaagaggagacaggaacttttaattagctgctagaatgctatacctagccccaatcctttctaagcattgaggaaaacaagtgaccggatggaatcagctcttctacaccccaaataatttcactttataaaactagatgaaatgaagtcccatttctctggagaggacagccagcccaatctgacttgggtaatgtttctgtctttcttcctttccttcctcacaaacttccagtcatagccccatgtgtcctgccatatggtgtccctgtttgtttgtttctcctttcttcctttctttctttttctttcttcctttcctttcctttccttcttcctttcttcctttctttctttcttttgagacagagtctcactctgtcacacaggctggagtgtagtggtgagatctcggctcgctgcaacctccgtctcccaggttcaagcaattcttctgcctcagcctcctgagtagctgggactacaggcacacaccaccatgcccggctaatttttgtatttttagtagaaacggggtttcaccatgctggcaaggctggtctcgaactcctgaccttgtgatccgcccacttcggcctcccaaaatgctgagattacaggcgtgagccaccgtgcctggcaactggtatcccagtttctgcctgatgtttaagcccctctaaattctggccacacgcatactcctgtgcacctgaccttatttcccgcaattccccaaccccattctgagatgcagtgacatgtcctgtactctcctacaggttttgttcatttcattgaacttaactcaggatgctctccctttgtttgaccacttaagtccagcccctttctcgaaaatttaaccaaagccccacctctttcatcaagtgttctgtgaacactctgtgctttagtactcccaagccttggaaaaccttcacacaccccctaagtttaagattactcatattctgccttgtagaatatattaactttgccttctgcacagctcttggcacagaacagaagacaccgtaggtacccttctaaaccttaatttggggttagggttcaaaggacagccttgtagtcaatgtaatgcagaagaagatgtgcttctgttccagtctggcaaagacaaacactgatggttgaggctattagcaggacgtgcatggtgggcacatgaagatagtctcctccactgcatctcatggctcaccctgcatagttatttgtaaaaggattttgagataattgagcaatttatgtgtgtgtgagagagagactccaggagggaagggggtgggggaggaatgggtgtttacagggtgggagttggtgcaccttgtttgttttgggtcatctccctcctctcccctgtcccaacatgtatcttttatctaatctatgtcttcaggaggcagtccaggcttactaattgtgatcaatcacaactcattcttaagttcatggccaagccttcagtgtcaatgtgatagaagcaatttctgtctctattttagccccgccactactgtctttttttcttttcacacattaggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcataggtgagcaagtggttaacatatttgtgttgctggagatagcttagcttccagtcacaaggaatgttgtaattggcagctatgaaatttgtttgtttaagtgtttgctatttagtgtttgtcagaatcctgactacgctcaactactttgagaatagtaaaaacattactgcaagtgaatgttccctcaaactaatggtggcatttctgaaggtaatagatacagtggctgccaggttttaataatgagaaaatgcctttttcttggagacagagtctctttctgtcacctaggctggagtatagcagcacaatcatagctctgtgtaacctgaaactcctgggttcaagcgatcctctcaccctcagccccccaaaagccctgggattataggcatgagccactcactgagaaagtgtctttttgatatttcccgcctgaaagtcagttgtgtttatgattataggcttgtatccatgtaaatgctggagtacagtcctcatggagttgtaaaagtggcttttaaaatgttatatctattacactgcaactaaatcttctgcaaaccggccagatacgcatttgttatttggatcaggtgaaatctgattgagaaattcagggattctgtttctgtacaccatttagcagtagtagtctgctctggtgagagtggaaggactttagccctgagaatttaagggatacatattcctgcatatatattccacctagaaaaccattctcagaacccagacagcaatgtaaatgaagtggccaattgcagagagggttagttatgattttggggaaaggacaaattaaggagaatttaaatgtccagttgtcaattaccttgatgcctgaagcaacagtaaccagtgttgaagttccttatgctgagtattagtaggaccgcacacacatactaacagctcacaaaaagaaactcacatttttccccaccctagtcacctttgcataattgccgaatttgagtgtctttataagcacctgtttttcacttatttgtccaaatcatgggaacatgtatgcagtattctggcttggttttttggggggaggtgaggggtgttaatgttggggaatgctttttagtctgtgtgagagctaattaccatattaactccgtttgaaagtgcatcaataaattggctccaacagattcttaagaacactgacacagggggataaaaaaagatgtgaatattaagcacttcagcacaattgtagcctaaatagctcaaagctagaagacctgaaaaaatcttctacacacagaaaagcagaatctcatgaaagggaaggcataagaccagcaaagacatacaggccaaatggcacatcatgcccagaatgaagccatgggagaaattgttgattcaaaatatttctcatggaagtaaaaacccatagaatttccagatctaaagtcgctgtttttgttttctctctctctctttaatcccacactcatccccacacccaaatgtcaagtttgcagttcacttttgcaaaattgaatttttaaagaaagttggtgatccttttcaattgcccctataattcactgtttctccaggcaaggtagtagaatttgccatatggtacaaaaaagtgtatggtgacagtgatcgaattctgctgacttttctacagacacattgggaatggaatgcagaagggcatggcccttgccactattttgatactctaacatgtctagcagcaactataactaaactcatatccttatattaaaatacaaatgctcctacgtgtttttcctggagtttacaggtccatatcaaatcaaaaccacactctggctttctttattgatgttttaaatcagttactcgaaaacaaagaggacttaagttgctgttgttgttcttgttgggcatttttaaaattacatttgttatctttgaagaaacaaacccaagtagaagttgataggatttctgaatcgatttttccctagttattttaagtgataactttttggagggatgaggtatataattgtatctaaactttgtttttaatgggtatactattctttatttctaataagcagatataaaagaccaggagtaatagacattgttaatctccagtgctttttcatgaatttttcacaagggtttaattaatctgctttgtggttgtagaattcagtcccaatttacatgcctctgctgtaaattctttttttatttcttgtctctctctctttttttttttttctgtttgcaaggaatttttctttcccctttaaatgactgcagctaatgaatggtcaagggctttttcccccttctttaaatcagatcttggggttaagtcgggaaactgccttttgttcttccagtcaggtcgggaggctgaagatgtgggtttctgattattggcagcacaatgcaaaaggaatcgctttccctagtgagaaggggatgctttgttgctgggggtatggggggaaactcagtgccagtgtcttgagcactgaaataatgcagttggactagaccctttaagagactaaggatgaactggttttccaaatccgtcttcttgttgccatgctcttcctctcctctcttaactgcatctgcaactggccatgaattgagaccctttagtaaatgttgaagtcttgtcagccttttatcaggatggatccaaatagttaaaacaccttagaacttggttttataagacgctggtttatatgaaaccttcacttggaaatataaaccaaatacctcccttgcccccaccaacaaaagtcagtttctggagaatcataaattatgctatgcaacttgttctccatcacatactgtagctgtgttaacactcatttgactcagggccaaccctattaatgtcgcatgttgctgccagtgggaatttagtattgggattgctggcggggacaccagccaggtcctggcaggaggcaggagccagtcagatatcccgcaaacaagggcctccgtggctcgtatcagccagaagaaaacccaaactccaaaccaatcatctttggctttctcttgaggcttcttatcagggctggctgctgttacagaagagccaattgatagccaatcatgacttcctccaggggttagaggcagctttggctcccgggctgcagagtgcaggcagaatgctcttcagttgcattcttcagctgcgcaacacacaacaccatggcaccggccccaacaaaggcccagcttccccctccattcccaggctcttgtgtatagccggctggctcagagtttacaaagacgccaaacagccagaagaattggggtttatgtttcctttcagtctttcacaaacacattagtgatctggccattccttgccactaggggaataaggagttacaaaatgcactgggttttgttgttgttgttgttgttgttatttaaacgtctgcattttagatgtttattttctgtctattcataatatttttattgggagcaggtgatttcttctcagcttacgaaggaatgtgctttctgtacgtggcagccctgatgatttgacaatgatgaacacatttaagttgtgctccacttgtttacaaaagtctccttttgctagcacatcaaaagcattttttttctctcctgtagtacaatggtatattcatgctttcagcccttacttagagttagaagcatcacttgattggcgcttaccacaatgcattctgaaacttcatttgttattactgttttaaaaattgcatttcatggaaatctatttgtggtttgtgacatcggaattgtagtttagagaaatgaccccgtgcattaaaatgttgtgtagcatttgttctaggttgaaggtgaaagcttgatgactagatttggtttcattgatatgctgatgcctatgctgctttccactagaaagcttagatagaagctcagctgggggctgcaattgtcagctgtgttctttgggtaggacacaatcttccgggaactagctcttctttcaagtaaccatccttgcactacctgaagatgatagataatgtgggtctaactcctttcttgccatgcactaagcactagagtgtaaaggggggataaacaagtttaaaagttcactgtttgtcgttaatgaagcatcctttttgtcatttggggttttcatttccaagttcttctaattttgtaaaacaggtagcaggcaaaaatactaagcctcataatcctaagaaacatatatggcaagaaaacaaagacaatgtattttattgaagcgattcagtgcttactggaaaatgccatgctactccagagtctaaagcaggataatcggtgaagatatatactgtgagcccactaattttgtgtactgtatcttgtgtcatcttctcacttgcaaaaaaaaggaggtacatgccttaagataaattgaagccattgtatttgcaatgagaagtttttcttaatacaaaaattggattattcaaagttttagtatttgaaaagtcattagaattcctaggaaccctttcatttgtattatccaacggtgcactcaaggatctgaggggttttgtttttaaaaacaaaagaaaagaattaatatgccagcatcttaactgatttatgtttttgactcttgtaaatggaatgtgaaacgagaagatcctagggaagtctctgggagagctggcatgttattttgtctccagccttaggtttgtcatctgggagctaactaagagccttacagtgacagtggctgacacacgaataatcagtattgaggaaagttcctgattgggtttccttgctgtagaactaagccttcatctggccatttcacactttagagagctagtgatacatagtgactaaatgcagtttggtgtaagggaaatagacataaaaacaagaattcattatgatccatgccttacttcccctgcccccatgcaggaaacagacagaaaaaaaaatcagattgatttacccaaggccaaactaatgattgactttttatgctgtattgttcttccccaaacctcatattagatgctatgctgatggtggcagagaggctagagggtcctttcaacattgaatcggtcatggatcccatcgatgtgaagatttctgatgctattatgaacatgcaggataatagtgttcaagtgtctcagaaggtaatgaaggcaggatgctggaaaggggagctagggacctcccccgcctccgcctcccgccttgggagtgacttccctaacatgacgacacttactctaatgcaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggtgagcgttttggcaggaagggccgtgtttaatgacaaagaactgaaaactcttgctcaaaatgaatttttagctggaaggctaacaagtgtgggtctttcaggtgtcacttttcaagcaaataggatgtggatgtcagtcaatctgcctgtcccattttctagcccagaaagttcttgggtagccaaggagttatgatgcaataagtcttgtctcaaaatttctctttagattcaccatgcatttattgaacatctactatgtgcccatcactgtgctaggcatagagaagctcagagaaataaggcagatccttgttctcaaaaggcaccaacaaggaggcaaagagggagaagtagatgttccaggcttattaacataaaatgatgtttagtaaaagctgagatgggagaaaagtgagtaactgtaggcaaattgctttatccacagtaatatgctacaaaaatgtaagaaactattcctacagtagtaggaacacagaagagggagcctgaggagacagggatggagagaaagagcaatagcagctatgtttcacagagtgcataatatacatgcttgatcctgactctaaaagccttaggagaagagactgcatgttatctttgtgcctacagggcatggagactggtaggcctcagatggtacttacaatgaggtgggcaaggggtctaggccactcctttggagcttgcatttcaactattatttgagtggttttgtacttctaagatataaattggagttgcatcttcctcttctaattaaagttgaaaatgaattgcatatcactctggagatactttggaaatggccagaaggcacacttgtaggtagttttgtcttgtcttacaatgatctttttttgttgttgttgtttcataattaggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggttagtgtctgttgaatgaatttgaagtttctcccttcctagatgcctgggtgaccttcagagagggttctctcaattgtcaaccgaggcatcaggaagcaattcacagtaggtagcaacaacatggaaggcttctaggtgttcttaggaacaggctttgcactaggagtgttgagaaggcacccagttacttacaaagagtgctgagtcaaaagtttgacagtagttatagtctcgtattagggctgttccaatagtgtcattatttttaaaatatttaatgcctgtggctctttgtccaatggcctagcctcataaataaccagttctcaaaggttccattctctgacttgatgccctgtgtccctcccttagacgctcagtaacttagagaagtacccatacttttttttgtttgcttgtttgagatggagtctcgctcttttgcccaagctggagtgtagtggcacaatctcggctcactgcaacctccacctcccgggttcaagtgattctcctgcctcagtctcctgagtagctaggactacaggtgcctgccaccatgcctggctaatttttttttttttgtatttttagtagtgacagggtttcaccatgttagccaggatggtcttgatctcctgaccttgtgatccgcctgcctcagcctcccaaagtgctgggattacaggtgtgagccaccgcacccagccagtacccatacttctttacttcaacccaccatcctcctcaagagggatagctagcttccttccttccttccttccttccttccttccttccttccttccttccttcctccaacagagtatcactgtcaccctgctagaattcagtggcacaatcttggctcattgcaacctcactgcaatctcagctgctggaatgcagtggtgcaaccttggctcactgcaaccttcgcctcctgggttcaagtgattctcctgtgtcagcttcctgagtatctgggattacaggcacacaccaccacacccggctcattttcatatttttagtagagacagggtttcgctatgttggccaggttggtctcgaatgcctgacctcaagtgatccacccaccttagcctccaaaagtgctgtgatagctttgaagaaggtttccatcaaattggagaaatgaggaatccacaggaacaagaaagattagagttcattaggaattaaagaacttccatctaattttgcttagtggaaatactagaatctagcagaagtatttgataacctcttgtataatcttcataatcttcacgcctgtaatcccagcactttgggaggcagacagataaaatcttttcgctttacgaatcatcttactggggtcattttacattccaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtaagcatttgtggtttgaaagtacgaattgctcttgtatgtcttctgatgagaacaagtggaatgaaatttctattccatttttttttaaactaggtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacg

SEQ ID NO: 5884 - DNA, 40515 bp, human
tgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttggcctcccaaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaaaaggtaggaaaaggaccaaccagatcagcagagaagagttgccttggagttttcttttagttttctgcagttcattagatagtaactaggccatgtcattttactcccttgtagtgaagatatgttgaagttgtactggtatactcttctacctttctgtaattttatattgtgtagacttgataaaatttatgtgtcaatcaccaccattaatatcaatattgagcctcaattcttatttttctgcccagtggctgccaaattactaacatttacaataattcactactactaagataatctactagttcgatcacatacttcaaattgttatggaactactgtcttcagcattgtgcttctgataactgataagtataattttttttttgtccagagtgaacatgtctattcttccactgtacacactaataaaaggaaaaattgtaatattgggtaaattcatgtccttacacatgtagtagttatgagcccatgtccctagaatgagtaataatttatccctcccttggttgaatagtcaagaatgctgattttaattcttctaacagctttatccctcagaagggaaggcaagcaagttatatatgtagtttatttgtaagactgatatgaaattggaagatgaatctactattagctttaattatttttacatttaggaatattgcatcagtaactcataattttggttttctgttatcctgagttaacacaaattatccaaggagatggcggatcatctgctttgaggtgtttttttttgagaattttaatgtatctgaatataaaaggtaaaaatatgccaactagcaatttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcgattatagcaaaagtattgattttcattccagacaaaagtcagaatgaaaggtaatttctcaatactctttcagattaataaaagtacctgtagcgatttttatcattcacaagtatatcacaagtaagttagaatttgagaactgtgttctagatctctgaggagatgcagtcagatttctgaactgtctcagcaaatggtaagtaacttagagctagtaattaataacctgtcctttgatttctgattcagccaagaatggccatatttgggaaaggcagatctggagagtaaccacgttttcattcatttaccacttctaggcccctccagagctctcagatattttggggttgagcccttccccaaagccatacaggaccttttttttgtgatctgttctagccatttttatgttgggtgcttgttatggactgagcatttatgtcctcccacaccccccccataccttttttgaagtcctaacccccagtgtgatggtatttggagacagggcctttggaaggtaattacagttagaagaagtcgggagggttgggcccaggtctgattggattagtgcccttatatgaaaagacaccaggacgggcgcagtggctcacacctgtaatcccagcactttgggaggccaaggtgggtggatcacgaggtcaggagtttgagaccagcctggccaatgtagtgaaacaccatctctactaaaaatacaaaaattagctgggtgtggtagcgggctcctgtcatccaagctactcgggagggtgaggcatgagaatcacttgaacccgggagttggaggttgcagtgagcccagattgtgccactgtactccagcctgggtgacagagtgagactctgtctcaaaaaagaaaaaaaaaaaaaaagagacaccagagagcttgttagaagaggtcatgtgagcacacagttagaagaccttcaagccaaagaagaggcctgagattgaaacctaccttgcaggtaccttaattttggacttcccagcctccaaaactgtgagaaataagtttctgttaagtcactcagtctgtggtattttgttatggcagcctgagcaggtagttgttctttcagaaggtgttgataataaccacatgcaacaccaagtcacaaataataaaacagatgtaacttatattcatacagaaagttgggcactgccattgccttgttggtttacacggctgtgctagttcagtagcagaaaggtgctggtctcctttactcagtttacaatctaggcagtagaatgtaatcactgctttaaacttgatactgcttagggagagaatcattggtgctgggtaactttgggttctaggtttactttttgtgtatatataactgtttttggtaaatcacaagtttctgggcttgtcgaattagattttgttacagattatgagctttattatgctatacagttagttgtatgtatatatgcctttcccactagattttaagctttttttttttttttttttttgtgacggagtcttgctcttgtcgcccaggctgaagtggagtgcagtggcacaatctcggctcactgcagcctccacctcctaggttcaagcgattctcctgcctcggcctcccaagtaactgggactacaggcacgtgccaccacacccggctaatttttgtattttttgtagagacagggtttcgccatgttggctaggctggtcttgaacttctggcctcaggtgatccacccgcctcagcctcccaaagtgctgggatttacaggcatgagccaccacgcccagctataagctctttaagggttgtaaatttataatcattcttttactctcctgcaaattctgttgcacactgccttaatcaaggtagatgctgaatgcatttttgtataattgaatatgttgcaatccccaactctctccaactgttcctgtcaaagcagccactggattgttaactaatccatattagatggggttaattaatatcagatgggacaagtaagggctaataagattataggccaccaagtagatttctgtctagctcttatagagattgagtttattggacctgtttgataggaagttttggtgtttgggatgattaaaactgaagttcctatttattgaattatacctatttatattatttcatatcagtggtccacatgcaagtgaggcttctgagacagagtttgagttctctcttcaactaccataacacttaacctgtatctttttttttttttttttttttagacggagtctcgctctgtcactcaggctggagtgtagtggtatgatctcggctcactgtaacctctgcctcctggattcaagcagttctccatgtctcagcctccctagtagctgggattacaggcctgtgccaccatgcctggctaattttttttttgtatttttagtagagacggggttttaccacgttggccaggctggtctcgaactcttgacctcgagcgatcaacttgccttggcctcccaaagtgctgggattacaggcatgagccacagcgcccagccgtctttttttttaaatagcaatttaacactgttcacagttactcatgtacatgtcatgccatctattacactgtaagttctgtgagggtagctgtatcaaatttatctaactctctctagtatgcatgacatagtaagtattcaataaatatttgcatattagtgataaggatacaggttctgaatagtgggtccttaccatttaagaattagtatttgatggccgggcggggtggctcacgcctgtaatcccagcactttgggaggctgaggcgggcggatcatgagatcaggagatcgagaccatcctggctaacatggtgaaatcccgtctttacaaaaaaaatacaaaagaattaaccaagtgtggtggtgggtgcctgtagtcccagctactgctttgtgaggctgaggcaggcagatcacctgaggtgggaaattcaagaccagcctgaccaacatggagaaaccccatctctactaaaaatacaaaattagccgggcgtggtggcgcatgtctgtaatcccagctactcgggaggctgaggcaggagaatggcgtgaacccgggaggcggagcttgcagtgagccaggatcgcgccactgcactccagcctgggcgacagagcgagactccgtctcaaaaaaaaaaaaaaaaaaaaaattagtatttgatatttgatcattaaatatgaattaagaggacttagactttttgttaaatgtcaagctgggaaaagttgtcatttaaatgaattgcctcttatttaatttcgtctgatgatacattttgtttttattttgtaaaaaattattttttttctttttggagacagggtcttgctctgttgcccaggctggtcacaaactcctgacctcaagcaatcctcctgccttagcctcccaaaatgctgggattacaggcgtgagccacctcgcccggccttgtattatgatacattttgaacaactacaagtagacttggtataatgaacctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaagagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaaaaaaatttagaatatatagcaaagcaataaagaactaaataaaattgctgtaactcctctttcaaagataagtgcttttatgattttgttgtatttttttctgtatataggtacatatatagtatttataaagctgtactcatagtacattttcacatcacaggtaccatatcagtgttattaaatattttgtatgccaggggctagacataccaagacaaccaatatgtggttctacttaaataatattagagtatcttttatgatgacacttcatgagttgactataataatcttagacttctaagagtttgggttttcaaaagatcacttagcttttttgggtgatttttcccccttactgtgagatgagagaggctgtttggatttgggattggggtagcggggacagcaacttttcttttctttttcttttttattttgaggtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccaccacaccatgccagtttttcctgttcagtgtgatattttatcttgttagactacagtgtgttaaaacttgttttactaaattttcaaacatactcaaaagtggagagaatagtataatgaatacccgtatgttcatcacccatgtttagaatattattaaatataaagattttgctgcgtttgtcttagctctttaaaatttttctttttctctttgtgacctaaaggaaattccatatcttatcactttacttctacattcttgactaagatgactaagacatatagttacatggttttttgttttgttttttgttttttaaagacgaaatctcgctcttgtcccccaggctggagtgcaatggtgccatctcagctcagtgcaacctctgccttctgggtacaagcgattctcctgcctcagcctcccaagtagctgggattacaggctcctgccaccacgcctggctaatttttgtatttttagtagagacggcggggggaggtttcaccatgttgacaaggctggtctggaactcctgacctcaggtgatccacccgcctcggcctcccaaagtgctgggattacaggcgtgagccaccgcgcccagcctgtttttttgtttgtttgttttgttttttttgagacagagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaacaagaagactaaagttctctcctttcagccttctgtacacatttcttctcaagcactggctatgcatgtatactatatgcaaaagtacatatatacatttatattttaacgtatgagtatagttttaaatgttattggacacttttaatattagtgtgtctagagctatctaatatattttaaaggttgcatagcattctgtcttatggagataccataactgatttaaccagtccactattgatagacactattttgttcttaccgactgtactagaagaaacattcttttacatgtttggtacttgttcagctttattcaagtggaatttctgggtcaaggggaaagagtttattgaatattttggtattgccaaattttcctctaagaagttgaatcattttatactcctgatgttatatgagagtacctttctcttcacaatttgtctcttttttttttttttttgagacaaggtctctgttgcccaggctggggtgcagtgcagcagaatgatcacagttcactgcagtctcaacctcctgggttcaagcgatccttccacctcagcctcctgagtagctgggactataggtgtgcgccaccactcccagctaatatttttattttgtagaaacagggttcgccatgttacccagcctcccaaagtgctgggattacaggcatgagccactggcccagtttctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactgtattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccacagtctgcctgtgtcacacaattgaaatgcatcacaacattgacactgtggatgaaacaaaatcagtgtgaattttagtagtgaatttcattcataatttgatcgtgcaaacgtttgatttttattactttagactattgtttctgattttatgttgggttggtatttcctgtgagttactgttttcctttaaaataggaatttttcatactcttcaaagattagaacaaatgtccagtttttgctgtttcatgaatgagtcctgtccatctttgtagaaactcgccttatgttcacatttttattgagaataagaccacttatctacatttaactatcaacctcatcctctccattaatcatctattttagtgacccaagtttttgaccttttccatgtttacatcaatcctgtaggtgattgggcagccatttaagtattattatagacattttcactatcccattaaaaccctttatgcccatacatcataacactacttcctacccataagctccttttaacttgttaaagtcttgcttgaattaaagacttgtttaaacacaaaatttagacttttactcaacaaaagtgattgattgattgattgattgattgatggtttacagtaggacttcattctagtcattatagctgctggcagtataactggccagcctttaatacattgctgcttagagtcaaagcatgtacttagagttggtatgatttatctttttggtcttctatagcctccttccccatccccatcagtcttaatcagtcttgttacgttatgactaatctttggggatttgtgcagaatgttattttagataagcaaaaacgagcaaaataggggagtttaactttaatattttcttttaaaaagcatttcatgttataagatcaattctgagtggtagaaatgctttgacattttatttccattttctacttttagtttttttcctatttgtttaagatcttagaggattattaagctgaactcctcaactgataaaaagcatgacatcttaaacataagcaaagcatatttttaggttaattttcacatagaaaacagtttattttatgtgaaattctatgtagatatactatttttttggtatttattgatatgtttattttattttattttattttattttattttattttattttatttatttatttttttttttgagacagagtctcactctgttgcccaggctggagtgcagtggcatgatcgtagctcactgcaacctccacctcccgggttcaagcaattcttctgtctcagcctcccgagtagctgggactacaggtgcctgccactatgcccggctaatttttgtgtttttagtagagatggggtttcaccttgttggtcaggctggtctcgaacccctgacctcaggtgatccacccacctcagcctcccaaagtgctgggattataggcatgagccaccgtgcccggccgacatgttaattttttaaaaaaggctttactggggtatattttatataatataataatcacatgttttaactatacaattccaagctttttagtatatttatagggctatgcaaggaagatatactgttaaacagtagaaattgagaaagctcttctgataatatctcttgatttgatgatggctcatgcctgtaatctcagtgctttggaaggccaagacagcagaatcacttgaggccaggggttcgagaccagcctgggcaacacagcaataccctatctttacaaataataaaaatatctgttgatttgaagtaaagtttttttttaaagacaaggtctcattctgtcacccaggctggaatgcagtagcaagatcacagctcactgtggccttgaccttctgggctcaagtgattctcccacttcggcctcccgagtagctgggactaacaggtgtgcaccaccatggctggctaatttttttttatgtttgtagagattgggtcttactgtgttgcccaggctgatcccgaactcctgggctcaagcagtcttcctgcctcagcctctaaaattgctgggattacaggcttgagtcaccatgcccagcctgaagtagcatttctaccctgtttaataattcagcagcttgtcatgtaagatattcatatatgcatataaaacattaggcagcttaatttggtaaaactgtaaaatggaaattttaaattgtttgcagcatcaataacattgatgtcagtatgatttttacatgctgatcttgaccaatttgaaacagtgagttaaaatctggctgatccgtactaatcctaaagaaatattctatgaactattaaatgtttccagaatatataaagaaacattatgatgtcaacacacccatctatttttttttggaaataaaaactccatttttcttattaaagaaaacatgcttattagaaaacatacggctgggtgcagtggcacacatgtaattccagtgctttgggagatcgaggtgggagaatcacttgaggccaggagtttgagaccagcctagacaacataatgagaccccctctctacacaaaaagaattagttgtgcatggtggcgtgcacctgtagtcccagctacttgggaggcagaggcaggagcatcccttgagcctaggagtttgagactgcaggagttcgagactgagtggaatgcagtggaactgcattccagcctgagtgacagagggagaccctgtcttaaaaaaataagaaagaaaacacaactgcagaaaattataaaggatttaagtcattccaaatatcactgccactttttatttagaatattctaaagaattctctctctgtgtacacacacacatatgcgtactcttaatccaagtagcttggtaggattttatttacctagtgcctagatgggaaattgcctggggattccaaatacctatttcattaaattaaagatgtcactgattttaagacttaacactatttttcatactgccaagaaagaaaacactaccagttataaatgtaaattgccatcaattgtaatacatcaattttagagctattattaataaaatgtgaatgtgcatcttagagcaatgaaatatagtactatatatttgatgaccttttctgccctgtgatattcagaaagtgaaagttaaatatgggctgagcatggtggctcacacctgtaatcccagtactttgggaagtcaagacgggaggctggcttgaacccaggagttcaagaccagcctaggcaatgtagcgagacgccatctcaaaatattaaaaataagtaaataagtaaataaaaagaaggttaagtatacaaatgtatttcctttgttgtgaatttatttcaattttatagtgattttttttttttgagacgaagtctcactcttgtcccccaggctggagtgcgatggcgtgatctcagctcactgcaacctctgcctcccaggttcaagctatactcctgccttggccccccgagtagctgggattacaggcgcctgctaccatgcctggctaatttttgtatttttagttgagatggggtttcaccatgttggccaggctggtctagaactcttgacctctggtgatccacccgcctcggactcccaaaatgctgggattacaggcgtgagccaccgtgcctggccagtggttttttgttgttgttgttgttgttgttttgtttttgtttttgtttttgttttgagacaggatcttgctctgtcacccaggctggagtgcagtggtgccatcttggttcactgcaacctctgcgtgggctcaagcaatcctcccacctccctttccagagtagcggggaccacaggtgtgtgccaccacacctgactaatttttgcatttttttttgtagaaacagggttttgccatgttgcccaggttggtctgaaactcctgagctcaaacaatccaactgccttggcttccctaagtgaaattacaggcatgggccactgtacccagtctagtgatttttttatttttatttttattttattttattttatttttttaccaaaaaaacaacaaagcctcaggaggaaaagttgatacacaagtaaattttattggaaatgtttttgtgtggaccttaagcagagggaaaattagtctgcattatggtgtatccagactaaatgactgatattaaaatgaaattattcttaggatttgcaatcttagagaaaactttttcatttttatttttttgagttacaaattatcttcatttacatttgagaacagtgagtcacagagggattaagtaacttactcaagatcatacaagtctttgatttgaacccaatcttttaactctgcagaactcagagtcactcttatttggaaaaactttttaactgatgtggatcctctaatatgggcttcctattattcattctctattagtcagaagttttgcaagcagacagaattcattttgccaattacgggattttccctcagttgcagtcaaggttcataaaactataactctttatctttaattagaaatgtttttttttttgagacaaggtcttgctctgttgcccagactggaatgcagtggcatagtggcccattgcagctttgaactcctgggctcaagggatcctctgcctcagcctcccaagtatctgagactacaagtgcgtgccatcacccatggctattttaaaaaaaaaaaaaattgtagagatagggtcttgctgtgttgcccaggctggtctcaaactcctggtctcaagcaatccttctgccttggtctcccaaagtgctgagattacaggtgtcagccgttgcacctggccaaaacgataacttaaaatacacacacacacacacacacacaaacacatatgtgtatttgtgtgtgtgtgtgtgtgtgtgtgtctcaaaaggtatcaaaagagaatagctataactttagtgttgatcttgatagtgacttgattaggctctgtttaacatcaaagatgcaaattaatactttctttgaacatattaaaaatgcagaaaatattggagtattttattttaaataaattgtattctgtatatttaaggtatacaacatgatgttatgggatacatataggtggttaaaagattactgcagtgaagcaaattaacgtatccctcaactcacatagttacccattttttttttgttttggtggcaagaggagcttaaaatctcatttagtgtgaatcccaaatacagcacaattttattacctatatacttcatgttgtacattatatttctagacttgttcatcctacatatctgctactttgtatcctctgagctacatctccccattttctcacttgccccccaagtagtttcttaaagtgtctcatgtaagagggcagtagctttcagcttaaactttttctctgtatgtagtcgatttctttgaggtatacttttctctccagaatagttagatgtaggtataccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttgaatgtttgaaaatagtgtacttaaaaataccaggtggtttttgtttgttttttgtttttttctttttttgagacagggtctcactctgtcacccaggctggagtgtagtggtgcaatctcatctcattgcagtcttgacctcccaggctcaggttatctcccacctcagcctcccaagtagctgggactacaggcacatgccaccacgcccagctaattttttgtattttttgtagagacggggtttcaccctgttgcccaggctggtctagaactcctgggcttaagcgatcctcccacctcagcctcccaaagtgctaggattacaggcatgagccaccatgcctggcagaaaataccaggtttttaagtatcagcacttactcttcaatcttttctattactatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacattaagggtatgtgtttgtagtcccaaagagcttctctggcaattttatgtagttgacagtgacgctctgagttcaggacagattggactccttggctgagaggagtgaggagataggacggtagaggagagggtagagcaactctggaggaagctttcccctcacctttgccagtcctgttatcctagacttaaccataattaaagatgagggaggcactcagtaaagggatctagtgggaagcttgttccagacagccaaggagggaggttcgcgcagttcctttggccacccaggtggggtaattgatccatgtatgccattcatgtacaatgtaggcacttatacctgtattccaatgtagtgaactataccattactcttaaattaatattctttattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgattagggtgaggttgataatagcagccatagagttaagaggattaagtgctataatgcaagtagagctcttacaacagtttctggtaaatcactcaataaattcagacatactattattttaagaaatctcaaagagttttcttgtaccttaaaattctcctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactcgttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattatatatgatttatggtaataataatatatatgttacaaaatacatacaaaaatatagattaaacaaggtgaggtaaaaaatttaaaagttctaatctttcttgcaaaccagtggatcttttgtgccttactctggtaaacactgtcttagaagaatatatagaacattaaaatcttaatgctatagttatatgacagagtatgatgagagctacagataaacaacacatcatgaatcttcttgtggcagtgtttataaccattatgtgaaatgctgcctcattcttataactagcataagaacagataggactttctcgattttgaggggtaattattagatggtattttctgttaaggactcttccagctataaaattcttaaatgtagaaagcgaagtgagggtttatggtgagaggaagcattggtatcatgttttagtgtagtccaagaatatggacacatccagaaaatgcagatcaagtttagcctaatgagaaaatatattttggagtccatatggtaaattaaattatgtgatttttgagttattgtacaaatataattcttagaatgttagagtcaggagactataagagaccaactgcttcaagtttcatttaacacatgggaaactaaggccagagaaatttcaagacttgcccaagattagacctcttgttaagtaatgaaagtgttttaaaaacaggtgggtcaaattctgtttttaaaatttccattatgatgaaaatttcagtattacaggcttccaaatcccagcagatgggccacttgtttaaaggagagtttgatataataaagcatctaaaaacaagagtttggataattccttagggttgttatgatgtgatttgacttataattggaaataccgttttattcattgtactgattttcatttctctttttcttctagaatgtcttgattgtggaagtaagttcacatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgttaggttgtttccactgtttgctccttatttctcgtacctgaaatgtccttattccctcccttcttatcccatgtttaagtcatttaagacccagctcaaacgtcacctccacaaaaccttccttgatacccctttcctcttcaattcacttggaccttttgcatttaattttaatttttattttttttaagacagagtctcactctgtcaccaggctggagtgcagtggtatgatctcagctcactaactactctgcctcccaggttcaagcaattctcatgtctcagcctcccaagtagctgggactacaggtgtgcgccaccatgcctggctaattgtgtgtgtgtgtgtgtgtatgtatgtatgtatatatgtgtgtgtgtgtatatatatatatacacacacatatataaatatatatacatatatatatatacacacatatataaatatatatacatatatatatatacacacacacacacatatatatatatatagttttttttttttttaagtagagatggggttttgccatgttggccaggctggtctggcctcaagccatcctcccacctcggcctcgcaaagtgctggtattataggcatgagccactgtgcctggcctgcatttcattttaattataaaatattttgaactcagaaaaaagggtatgctgaatacctacgtacccacaaaagtattaacattttgccatatttgcttctgatcttattttttttgagaaattaaagatcataatacaactaaagccccatttctttcccttcattcccagaagtatgacaattatccttaaagttgatatatatcattcccatgcatgttttttatacttccctagtacaagttagctgtatcctctgctcaggggctcatcaagctgaatcaagggactcatgatcctcttcaaagttccttcaggttgttggcagaatttagttccttgtgattgtaggactgagggcccgttttctcactggctgctggccaggggttgctcccagatatttaaaggctcatgccctagcccatgacagtctcacaacatggcagctgacttcttcaaaaccagcaggagaatcttgctctagtctaccacataacctaatcacaggagcggctatcccgttattttcacagatcctggtcacattcaaggggagggaacccttctgtgtgtgtacaccaggaggcaggaattttttttttctttttcttttttgttaaaaagtcttaaagtcttttatccctaaaggaggcaggaattttgagagccatcagaattctgcctaccacagcccagaaatctgcatttttcacaagtctccagccatgatgtttctgatggctcacactgctttattccatttttaaagagtatttttattgaaaagcattagggttatggtttaaaaaatattttccctaacaaagatgggtttgtttagagtcctacttttgactaaatagctgagattcacttttatgtaaagtcattttatagcgttattaatttgggtgcctttaaaaatagtataaagcatgtttctcgagtgtagtctgttagccacctatattggagagttgggaggagagagtctctatcttgaatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaatgtcaacctactgtggcatagactttaatcctctgggtattcttttgttgttctttcctggtatatgctgtggaattgagatagactggttcgtgagcgagagattttgtgttgccacaggtaggacatgctcaaacaatacttgggtcatttcttgacccaagtcatctattcaccatagttttgtagcaccgatcttgcatacatttcatgtatcttctttgaaccccacgtcagtgctgcttatatgatactcagaaattaaacactaaggaataagattttcaggtaggattgagttttggagggtcacaaatcttgtaatgtctaatatttccactctccctgctgagaattagttttggcttccttggaggtgatatcgcctctgttgagtataagtggcctactgtgatcacaccactgcactccagcctgggtgacagagtgagaccctgtctcagaaaaaaaaaaaaaaaaaaagaatgcatggcctagatgacttctaaggtttttcccacccagttccagttttcatgttctaggcagagcagtaaagtgagaaacacatggacttgggagtttagtctcgcatttcactgccacttaatctgagcgactattccatatttaatctctctgaatgtatttactcatctttaaaggggaatgattattaacatctttttctcagggaaactatatgagtcaaggagataatatatttgaaaatctttttaactgcaaagcgctgtttcactgttggttataatgtgattgatctcattgtagtgagcagctgcttaattgcgttttagaatgtagggaagatagtaatatttttcacattatatatgtagctggttctggaactgtaaacatactccttttttatggagatctgagtcacgtaccataaaattcactcttttaaagttgtacaatccagtggtttttgatatattcagagttgtgcatctgctaccactatttcattttggaacccaaagaaaccttgtacccattagcagtcattctcccttctcccagcccctggcaactactaatctactttctacagaaagtccgtacagatttgtgtattatggacattccatataaatggactcatgcaatatcctgtcttctttcacttagcatagtgttttcaaggttcatctaggttggggcatgtatcagtacttcatcccttgttttggctgaataatatttcattgtacaaatatatcacattttgcttatccatctgttggtgaacatttgagtttctacctgttggcttttatgaataatgttgatttgaatgtttgtgtacaagtatgaatacctgttttcaggtctcttgagtatatagttgctaggtcatatagtaactctgtgtttaacattttgaggaattgcccgactatttaacaaggtatatgtactgttttacaccagtaacatatgagggttccaatatctccacatccttgacaacacttgttactgtcctttttattgtagccatcctagtggctatgatgtggtatctcattgtggttttgatttgtgtttctctgatgctgatgatgttgaacatgttttcatctgcttattggccatttacatatatcttcttaagaacggttacccatttacagtatggaaaatgcttcagatgcaactctagtcatgccttagagatggagctttattaaacattcagatctctaggcatatgaagtgctgagttctcttgaactcctaatacagattgcactgagtttagtgataccttttctggagcattcctgagttcaggtagggagaagggtttttgctgtgattggcttgttatgttctttctaaatggaaatagaattgaagtgtctcctctctccatttattggaagagtcatgagggacataattagatgatcccttggagtctccggcttaggtcagtggttatctacttaggctgcacattggaatcacctgagagttaaaaaaccaggataacctctgcctgtgtctcatctccagcaattctgatgtaattggtcagggctgtggcccgagtaggtgagttctggttttttaaagctcccaggtgattctgatgtgcaatccaggttgagatcactttgggccctttccagctctttaaacatatatatttatctaggaaggtatgaaagcataagttttcttgagactgcctttaacatctgtaaaggctttcaaagcagcttctgtagttttttttaaatggctgaatatttttcaacaggcagcatttgggttataaaattagcttttggtagagttgacttataccacctccagcttttgttccaaaaataaatactggttcttttggcacactagttgttttaccctaaagttcctctttgtaagccagttattaaaagttgtgatgcagccagggcgaagtggtacacatctgtagtcccagctactcggaaggctgaggggggaggatcgctagagcccaagaagtcaaggctgcagtgaactgtgattacaccactgcactgcagcctgggccacagagcgagactcatctctttaaaaaaaagaatgttgtgaggccgggcgcagtggctcacgcctgtgatcccagcactttgggaggccgaggtggacggatcacctgaggttgggagttcgagaccagcctgaccaacatggagaaaccctgtctctactaaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctcaaaaaaaagaaaagaaaagaaaagaatgttgtggccaggcgcggtggcttacgcctgtaatttcagcactttgggagaccgaggtgggcggatcacgaggtcaggagatcaagaccatcctggctaacacagtaaaaccccatctctactaaatacaaaaaaaaattagccgggagtgctggcgggtgcctgtagtcccagctactcaggaggctgaggcgggagaatggcgtgaacccaggaggcagagcttgcagtgagcggagatcgcgccactgcactccagcctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacaaaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtgaaaccccgtctctactaaaaaatagaaaaaattagctggggtggtggcgggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaa

SEQ ID NO: 5885 - DNA, 39912 bp, human
gcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttggcctcccaaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaaaaggtaggaaaaggaccaaccagatcagcagagaagagttgccttggagttttcttttagttttctgcagttcattagatagtaactaggccatgtcattttactcccttgtagtgaagatatgttgaagttgtactggtatactcttctacctttctgtaattttatattgtgtagacttgataaaatttatgtgtcaatcaccaccattaatatcaatattgagcctcaattcttatttttctgcccagtggctgccaaattactaacatttacaataattcactactactaagataatctactagttcgatcacatacttcaaattgttatggaactactgtcttcagcattgtgcttctgataactgataagtataattttttttttgtccagagtgaacatgtctattcttccactgtacacactaataaaaggaaaaattgtaatattgggtaaattcatgtccttacacatgtagtagttatgagcccatgtccctagaatgagtaataatttatccctcccttggttgaatagtcaagaatgctgattttaattcttctaacagctttatccctcagaagggaaggcaagcaagttatatatgtagtttatttgtaagactgatatgaaattggaagatgaatctactattagctttaattatttttacatttaggaatattgcatcagtaactcataattttggttttctgttatcctgagttaacacaaattatccaaggagatggcggatcatctgctttgaggtgtttttttttgagaattttaatgtatctgaatataaaaggtaaaaatatgccaactagcaatttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcgattatagcaaaagtattgattttcattccagacaaaagtcagaatgaaaggtaatttctcaatactctttcagattaataaaagtacctgtagcgatttttatcattcacaagtatatcacaagtaagttagaatttgagaactgtgttctagatctctgaggagatgcagtcagatttctgaactgtctcagcaaatggtaagtaacttagagctagtaattaataacctgtcctttgatttctgattcagccaagaatggccatatttgggaaaggcagatctggagagtaaccacgttttcattcatttaccacttctaggcccctccagagctctcagatattttggggttgagcccttccccaaagccatacaggaccttttttttgtgatctgttctagccatttttatgttgggtgcttgttatggactgagcatttatgtcctcccacaccccccccataccttttttgaagtcctaacccccagtgtgatggtatttggagacagggcctttggaaggtaattacagttagaagaagtcgggagggttgggcccaggtctgattggattagtgcccttatatgaaaagacaccaggacgggcgcagtggctcacacctgtaatcccagcactttgggaggccaaggtgggtggatcacgaggtcaggagtttgagaccagcctggccaatgtagtgaaacaccatctctactaaaaatacaaaaattagctgggtgtggtagcgggctcctgtcatccaagctactcgggagggtgaggcatgagaatcacttgaacccgggagttggaggttgcagtgagcccagattgtgccactgtactccagcctgggtgacagagtgagactctgtctcaaaaaagaaaaaaaaaaaaaaagagacaccagagagcttgttagaagaggtcatgtgagcacacagttagaagaccttcaagccaaagaagaggcctgagattgaaacctaccttgcaggtaccttaattttggacttcccagcctccaaaactgtgagaaataagtttctgttaagtcactcagtctgtggtattttgttatggcagcctgagcaggtagttgttctttcagaaggtgttgataataaccacatgcaacaccaagtcacaaataataaaacagatgtaacttatattcatacagaaagttgggcactgccattgccttgttggtttacacggctgtgctagttcagtagcagaaaggtgctggtctcctttactcagtttacaatctaggcagtagaatgtaatcactgctttaaacttgatactgcttagggagagaatcattggtgctgggtaactttgggttctaggtttactttttgtgtatatataactgtttttggtaaatcacaagtttctgggcttgtcgaattagattttgttacagattatgagctttattatgctatacagttagttgtatgtatatatgcctttcccactagattttaagctttttttttttttttttttttgtgacggagtcttgctcttgtcgcccaggctgaagtggagtgcagtggcacaatctcggctcactgcagcctccacctcctaggttcaagcgattctcctgcctcggcctcccaagtaactgggactacaggcacgtgccaccacacccggctaatttttgtattttttgtagagacagggtttcgccatgttggctaggctggtcttgaacttctggcctcaggtgatccacccgcctcagcctcccaaagtgctgggatttacaggcatgagccaccacgcccagctataagctctttaagggttgtaaatttataatcattcttttactctcctgcaaattctgttgcacactgccttaatcaaggtagatgctgaatgcatttttgtataattgaatatgttgcaatccccaactctctccaactgttcctgtcaaagcagccactggattgttaactaatccatattagatggggttaattaatatcagatgggacaagtaagggctaataagattataggccaccaagtagatttctgtctagctcttatagagattgagtttattggacctgtttgataggaagttttggtgtttgggatgattaaaactgaagttcctatttattgaattatacctatttatattatttcatatcagtggtccacatgcaagtgaggcttctgagacagagtttgagttctctcttcaactaccataacacttaacctgtatctttttttttttttttttttttagacggagtctcgctctgtcactcaggctggagtgtagtggtatgatctcggctcactgtaacctctgcctcctggattcaagcagttctccatgtctcagcctccctagtagctgggattacaggcctgtgccaccatgcctggctaattttttttttgtatttttagtagagacggggttttaccacgttggccaggctggtctcgaactcttgacctcgagcgatcaacttgccttggcctcccaaagtgctgggattacaggcatgagccacagcgcccagccgtctttttttttaaatagcaatttaacactgttcacagttactcatgtacatgtcatgccatctattacactgtaagttctgtgagggtagctgtatcaaatttatctaactctctctagtatgcatgacatagtaagtattcaataaatatttgcatattagtgataaggatacaggttctgaatagtgggtccttaccatttaagaattagtatttgatggccgggcggggtggctcacgcctgtaatcccagcactttgggaggctgaggcgggcggatcatgagatcaggagatcgagaccatcctggctaacatggtgaaatcccgtctttacaaaaaaaatacaaaagaattaaccaagtgtggtggtgggtgcctgtagtcccagctactgctttgtgaggctgaggcaggcagatcacctgaggtgggaaattcaagaccagcctgaccaacatggagaaaccccatctctactaaaaatacaaaattagccgggcgtggtggcgcatgtctgtaatcccagctactcgggaggctgaggcaggagaatggcgtgaacccgggaggcggagcttgcagtgagccaggatcgcgccactgcactccagcctgggcgacagagcgagactccgtctcaaaaaaaaaaaaaaaaaaaaaattagtatttgatatttgatcattaaatatgaattaagaggacttagactttttgttaaatgtcaagctgggaaaagttgtcatttaaatgaattgcctcttatttaatttcgtctgatgatacattttgtttttattttgtaaaaaattattttttttctttttggagacagggtcttgctctgttgcccaggctggtcacaaactcctgacctcaagcaatcctcctgccttagcctcccaaaatgctgggattacaggcgtgagccacctcgcccggccttgtattatgatacattttgaacaactacaagtagacttggtataatgaacctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaagagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaaaaaaatttagaatatatagcaaagcaataaagaactaaataaaattgctgtaactcctctttcaaagataagtgcttttatgattttgttgtatttttttctgtatataggtacatatatagtatttataaagctgtactcatagtacattttcacatcacaggtaccatatcagtgttattaaatattttgtatgccaggggctagacataccaagacaaccaatatgtggttctacttaaataatattagagtatcttttatgatgacacttcatgagttgactataataatcttagacttctaagagtttgggttttcaaaagatcacttagcttttttgggtgatttttcccccttactgtgagatgagagaggctgtttggatttgggattggggtagcggggacagcaacttttcttttctttttcttttttattttgaggtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccaccacaccatgccagtttttcctgttcagtgtgatattttatcttgttagactacagtgtgttaaaacttgttttactaaattttcaaacatactcaaaagtggagagaatagtataatgaatacccgtatgttcatcacccatgtttagaatattattaaatataaagattttgctgcgtttgtcttagctctttaaaatttttctttttctctttgtgacctaaaggaaattccatatcttatcactttacttctacattcttgactaagatgactaagacatatagttacatggttttttgttttgttttttgttttttaaagacgaaatctcgctcttgtcccccaggctggagtgcaatggtgccatctcagctcagtgcaacctctgccttctgggtacaagcgattctcctgcctcagcctcccaagtagctgggattacaggctcctgccaccacgcctggctaatttttgtatttttagtagagacggcggggggaggtttcaccatgttgacaaggctggtctggaactcctgacctcaggtgatccacccgcctcggcctcccaaagtgctgggattacaggcgtgagccaccgcgcccagcctgtttttttgtttgtttgttttgttttttttgagacagagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaacaagaagactaaagttctctcctttcagccttctgtacacatttcttctcaagcactggctatgcatgtatactatatgcaaaagtacatatatacatttatattttaacgtatgagtatagttttaaatgttattggacacttttaatattagtgtgtctagagctatctaatatattttaaaggttgcatagcattctgtcttatggagataccataactgatttaaccagtccactattgatagacactattttgttcttaccgactgtactagaagaaacattcttttacatgtttggtacttgttcagctttattcaagtggaatttctgggtcaaggggaaagagtttattgaatattttggtattgccaaattttcctctaagaagttgaatcattttatactcctgatgttatatgagagtacctttctcttcacaatttgtctcttttttttttttttttgagacaaggtctctgttgcccaggctggggtgcagtgcagcagaatgatcacagttcactgcagtctcaacctcctgggttcaagcgatccttccacctcagcctcctgagtagctgggactataggtgtgcgccaccactcccagctaatatttttattttgtagaaacagggttcgccatgttacccagcctcccaaagtgctgggattacaggcatgagccactggcccagtttctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactgtattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccacagtctgcctgtgtcacacaattgaaatgcatcacaacattgacactgtggatgaaacaaaatcagtgtgaattttagtagtgaatttcattcataatttgatcgtgcaaacgtttgatttttattactttagactattgtttctgattttatgttgggttggtatttcctgtgagttactgttttcctttaaaataggaatttttcatactcttcaaagattagaacaaatgtccagtttttgctgtttcatgaatgagtcctgtccatctttgtagaaactcgccttatgttcacatttttattgagaataagaccacttatctacatttaactatcaacctcatcctctccattaatcatctattttagtgacccaagtttttgaccttttccatgtttacatcaatcctgtaggtgattgggcagccatttaagtattattatagacattttcactatcccattaaaaccctttatgcccatacatcataacactacttcctacccataagctccttttaacttgttaaagtcttgcttgaattaaagacttgtttaaacacaaaatttagacttttactcaacaaaagtgattgattgattgattgattgattgatggtttacagtaggacttcattctagtcattatagctgctggcagtataactggccagcctttaatacattgctgcttagagtcaaagcatgtacttagagttggtatgatttatctttttggtcttctatagcctccttccccatccccatcagtcttaatcagtcttgttacgttatgactaatctttggggatttgtgcagaatgttattttagataagcaaaaacgagcaaaataggggagtttaactttaatattttcttttaaaaagcatttcatgttataagatcaattctgagtggtagaaatgctttgacattttatttccattttctacttttagtttttttcctatttgtttaagatcttagaggattattaagctgaactcctcaactgataaaaagcatgacatcttaaacataagcaaagcatatttttaggttaattttcacatagaaaacagtttattttatgtgaaattctatgtagatatactatttttttggtatttattgatatgtttattttattttattttattttattttattttattttattttatttatttatttttttttttgagacagagtctcactctgttgcccaggctggagtgcagtggcatgatcgtagctcactgcaacctccacctcccgggttcaagcaattcttctgtctcagcctcccgagtagctgggactacaggtgcctgccactatgcccggctaatttttgtgtttttagtagagatggggtttcaccttgttggtcaggctggtctcgaacccctgacctcaggtgatccacccacctcagcctcccaaagtgctgggattataggcatgagccaccgtgcccggccgacatgttaattttttaaaaaaggctttactggggtatattttatataatataataatcacatgttttaactatacaattccaagctttttagtatatttatagggctatgcaaggaagatatactgttaaacagtagaaattgagaaagctcttctgataatatctcttgatttgatgatggctcatgcctgtaatctcagtgctttggaaggccaagacagcagaatcacttgaggccaggggttcgagaccagcctgggcaacacagcaataccctatctttacaaataataaaaatatctgttgatttgaagtaaagtttttttttaaagacaaggtctcattctgtcacccaggctggaatgcagtagcaagatcacagctcactgtggccttgaccttctgggctcaagtgattctcccacttcggcctcccgagtagctgggactaacaggtgtgcaccaccatggctggctaatttttttttatgtttgtagagattgggtcttactgtgttgcccaggctgatcccgaactcctgggctcaagcagtcttcctgcctcagcctctaaaattgctgggattacaggcttgagtcaccatgcccagcctgaagtagcatttctaccctgtttaataattcagcagcttgtcatgtaagatattcatatatgcatataaaacattaggcagcttaatttggtaaaactgtaaaatggaaattttaaattgtttgcagcatcaataacattgatgtcagtatgatttttacatgctgatcttgaccaatttgaaacagtgagttaaaatctggctgatccgtactaatcctaaagaaatattctatgaactattaaatgtttccagaatatataaagaaacattatgatgtcaacacacccatctatttttttttggaaataaaaactccatttttcttattaaagaaaacatgcttattagaaaacatacggctgggtgcagtggcacacatgtaattccagtgctttgggagatcgaggtgggagaatcacttgaggccaggagtttgagaccagcctagacaacataatgagaccccctctctacacaaaaagaattagttgtgcatggtggcgtgcacctgtagtcccagctacttgggaggcagaggcaggagcatcccttgagcctaggagtttgagactgcaggagttcgagactgagtggaatgcagtggaactgcattccagcctgagtgacagagggagaccctgtcttaaaaaaataagaaagaaaacacaactgcagaaaattataaaggatttaagtcattccaaatatcactgccactttttatttagaatattctaaagaattctctctctgtgtacacacacacatatgcgtactcttaatccaagtagcttggtaggattttatttacctagtgcctagatgggaaattgcctggggattccaaatacctatttcattaaattaaagatgtcactgattttaagacttaacactatttttcatactgccaagaaagaaaacactaccagttataaatgtaaattgccatcaattgtaatacatcaattttagagctattattaataaaatgtgaatgtgcatcttagagcaatgaaatatagtactatatatttgatgaccttttctgccctgtgatattcagaaagtgaaagttaaatatgggctgagcatggtggctcacacctgtaatcccagtactttgggaagtcaagacgggaggctggcttgaacccaggagttcaagaccagcctaggcaatgtagcgagacgccatctcaaaatattaaaaataagtaaataagtaaataaaaagaaggttaagtatacaaatgtatttcctttgttgtgaatttatttcaattttatagtgattttttttttttgagacgaagtctcactcttgtcccccaggctggagtgcgatggcgtgatctcagctcactgcaacctctgcctcccaggttcaagctatactcctgccttggccccccgagtagctgggattacaggcgcctgctaccatgcctggctaatttttgtatttttagttgagatggggtttcaccatgttggccaggctggtctagaactcttgacctctggtgatccacccgcctcggactcccaaaatgctgggattacaggcgtgagccaccgtgcctggccagtggttttttgttgttgttgttgttgttgttttgtttttgtttttgtttttgttttgagacaggatcttgctctgtcacccaggctggagtgcagtggtgccatcttggttcactgcaacctctgcgtgggctcaagcaatcctcccacctccctttccagagtagcggggaccacaggtgtgtgccaccacacctgactaatttttgcatttttttttgtagaaacagggttttgccatgttgcccaggttggtctgaaactcctgagctcaaacaatccaactgccttggcttccctaagtgaaattacaggcatgggccactgtacccagtctagtgatttttttatttttatttttattttattttattttatttttttaccaaaaaaacaacaaagcctcaggaggaaaagttgatacacaagtaaattttattggaaatgtttttgtgtggaccttaagcagagggaaaattagtctgcattatggtgtatccagactaaatgactgatattaaaatgaaattattcttaggatttgcaatcttagagaaaactttttcatttttatttttttgagttacaaattatcttcatttacatttgagaacagtgagtcacagagggattaagtaacttactcaagatcatacaagtctttgatttgaacccaatcttttaactctgcagaactcagagtcactcttatttggaaaaactttttaactgatgtggatcctctaatatgggcttcctattattcattctctattagtcagaagttttgcaagcagacagaattcattttgccaattacgggattttccctcagttgcagtcaaggttcataaaactataactctttatctttaattagaaatgtttttttttttgagacaaggtcttgctctgttgcccagactggaatgcagtggcatagtggcccattgcagctttgaactcctgggctcaagggatcctctgcctcagcctcccaagtatctgagactacaagtgcgtgccatcacccatggctattttaaaaaaaaaaaaaattgtagagatagggtcttgctgtgttgcccaggctggtctcaaactcctggtctcaagcaatccttctgccttggtctcccaaagtgctgagattacaggtgtcagccgttgcacctggccaaaacgataacttaaaatacacacacacacacacacacacaaacacatatgtgtatttgtgtgtgtgtgtgtgtgtgtgtgtctcaaaaggtatcaaaagagaatagctataactttagtgttgatcttgatagtgacttgattaggctctgtttaacatcaaagatgcaaattaatactttctttgaacatattaaaaatgcagaaaatattggagtattttattttaaataaattgtattctgtatatttaaggtatacaacatgatgttatgggatacatataggtggttaaaagattactgcagtgaagcaaattaacgtatccctcaactcacatagttacccattttttttttgttttggtggcaagaggagcttaaaatctcatttagtgtgaatcccaaatacagcacaattttattacctatatacttcatgttgtacattatatttctagacttgttcatcctacatatctgctactttgtatcctctgagctacatctccccattttctcacttgccccccaagtagtttcttaaagtgtctcatgtaagagggcagtagctttcagcttaaactttttctctgtatgtagtcgatttctttgaggtatacttttctctccagaatagttagatgtaggtataccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttgaatgtttgaaaatagtgtacttaaaaataccaggtggtttttgtttgttttttgtttttttctttttttgagacagggtctcactctgtcacccaggctggagtgtagtggtgcaatctcatctcattgcagtcttgacctcccaggctcaggttatctcccacctcagcctcccaagtagctgggactacaggcacatgccaccacgcccagctaattttttgtattttttgtagagacggggtttcaccctgttgcccaggctggtctagaactcctgggcttaagcgatcctcccacctcagcctcccaaagtgctaggattacaggcatgagccaccatgcctggcagaaaataccaggtttttaagtatcagcacttactcttcaatcttttctattactatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacattaagggtatgtgtttgtagtcccaaagagcttctctggcaattttatgtagttgacagtgacgctctgagttcaggacagattggactccttggctgagaggagtgaggagataggacggtagaggagagggtagagcaactctggaggaagctttcccctcacctttgccagtcctgttatcctagacttaaccataattaaagatgagggaggcactcagtaaagggatctagtgggaagcttgttccagacagccaaggagggaggttcgcgcagttcctttggccacccaggtggggtaattgatccatgtatgccattcatgtacaatgtaggcacttatacctgtattccaatgtagtgaactataccattactcttaaattaatattctttattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgattagggtgaggttgataatagcagccatagagttaagaggattaagtgctataatgcaagtagagctcttacaacagtttctggtaaatcactcaataaattcagacatactattattttaagaaatctcaaagagttttcttgtaccttaaaattctcctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactcgttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattatatatgatttatggtaataataatatatatgttacaaaatacatacaaaaatatagattaaacaaggtgaggtaaaaaatttaaaagttctaatctttcttgcaaaccagtggatcttttgtgccttactctggtaaacactgtcttagaagaatatatagaacattaaaatcttaatgctatagttatatgacagagtatgatgagagctacagataaacaacacatcatgaatcttcttgtggcagtgtttataaccattatgtgaaatgctgcctcattcttataactagcataagaacagataggactttctcgattttgaggggtaattattagatggtattttctgttaaggactcttccagctataaaattcttaaatgtagaaagcgaagtgagggtttatggtgagaggaagcattggtatcatgttttagtgtagtccaagaatatggacacatccagaaaatgcagatcaagtttagcctaatgagaaaatatattttggagtccatatggtaaattaaattatgtgatttttgagttattgtacaaatataattcttagaatgttagagtcaggagactataagagaccaactgcttcaagtttcatttaacacatgggaaactaaggccagagaaatttcaagacttgcccaagattagacctcttgttaagtaatgaaagtgttttaaaaacaggtgggtcaaattctgtttttaaaatttccattatgatgaaaatttcagtattacaggcttccaaatcccagcagatgggccacttgtttaaaggagagtttgatataataaagcatctaaaaacaagagtttggataattccttagggttgttatgatgtgatttgacttataattggaaataccgttttattcattgtactgattttcatttctctttttcttctagaatgtcttgattgtggaagtaagttcacatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgttaggttgtttccactgtttgctccttatttctcgtacctgaaatgtccttattccctcccttcttatcccatgtttaagtcatttaagacccagctcaaacgtcacctccacaaaaccttccttgatacccctttcctcttcaattcacttggaccttttgcatttaattttaatttttattttttttaagacagagtctcactctgtcaccaggctggagtgcagtggtatgatctcagctcactaactactctgcctcccaggttcaagcaattctcatgtctcagcctcccaagtagctgggactacaggtgtgcgccaccatgcctggctaattgtgtgtgtgtgtgtgtgtatgtatgtatgtatatatgtgtgtgtgtgtatatatatatatacacacacatatataaatatatatacatatatatatatacacacatatataaatatatatacatatatatatatacacacacacacacatatatatatatatagttttttttttttttaagtagagatggggttttgccatgttggccaggctggtctggcctcaagccatcctcccacctcggcctcgcaaagtgctggtattataggcatgagccactgtgcctggcctgcatttcattttaattataaaatattttgaactcagaaaaaagggtatgctgaatacctacgtacccacaaaagtattaacattttgccatatttgcttctgatcttattttttttgagaaattaaagatcataatacaactaaagccccatttctttcccttcattcccagaagtatgacaattatccttaaagttgatatatatcattcccatgcatgttttttatacttccctagtacaagttagctgtatcctctgctcaggggctcatcaagctgaatcaagggactcatgatcctcttcaaagttccttcaggttgttggcagaatttagttccttgtgattgtaggactgagggcccgttttctcactggctgctggccaggggttgctcccagatatttaaaggctcatgccctagcccatgacagtctcacaacatggcagctgacttcttcaaaaccagcaggagaatcttgctctagtctaccacataacctaatcacaggagcggctatcccgttattttcacagatcctggtcacattcaaggggagggaacccttctgtgtgtgtacaccaggaggcaggaattttttttttctttttcttttttgttaaaaagtcttaaagtcttttatccctaaaggaggcaggaattttgagagccatcagaattctgcctaccacagcccagaaatctgcatttttcacaagtctccagccatgatgtttctgatggctcacactgctttattccatttttaaagagtatttttattgaaaagcattagggttatggtttaaaaaatattttccctaacaaagatgggtttgtttagagtcctacttttgactaaatagctgagattcacttttatgtaaagtcattttatagcgttattaatttgggtgcctttaaaaatagtataaagcatgtttctcgagtgtagtctgttagccacctatattggagagttgggaggagagagtctctatcttgaatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaatgtcaacctactgtggcatagactttaatcctctgggtattcttttgttgttctttcctggtatatgctgtggaattgagatagactggttcgtgagcgagagattttgtgttgccacaggtaggacatgctcaaacaatacttgggtcatttcttgacccaagtcatctattcaccatagttttgtagcaccgatcttgcatacatttcatgtatcttctttgaaccccacgtcagtgctgcttatatgatactcagaaattaaacactaaggaataagattttcaggtaggattgagttttggagggtcacaaatcttgtaatgtctaatatttccactctccctgctgagaattagttttggcttccttggaggtgatatcgcctctgttgagtataagtggcctactgtgatcacaccactgcactccagcctgggtgacagagtgagaccctgtctcagaaaaaaaaaaaaaaaaaaagaatgcatggcctagatgacttctaaggtttttcccacccagttccagttttcatgttctaggcagagcagtaaagtgagaaacacatggacttgggagtttagtctcgcatttcactgccacttaatctgagcgactattccatatttaatctctctgaatgtatttactcatctttaaaggggaatgattattaacatctttttctcagggaaactatatgagtcaaggagataatatatttgaaaatctttttaactgcaaagcgctgtttcactgttggttataatgtgattgatctcattgtagtgagcagctgcttaattgcgttttagaatgtagggaagatagtaatatttttcacattatatatgtagctggttctggaactgtaaacatactccttttttatggagatctgagtcacgtaccataaaattcactcttttaaagttgtacaatccagtggtttttgatatattcagagttgtgcatctgctaccactatttcattttggaacccaaagaaaccttgtacccattagcagtcattctcccttctcccagcccctggcaactactaatctactttctacagaaagtccgtacagatttgtgtattatggacattccatataaatggactcatgcaatatcctgtcttctttcacttagcatagtgttttcaaggttcatctaggttggggcatgtatcagtacttcatcccttgttttggctgaataatatttcattgtacaaatatatcacattttgcttatccatctgttggtgaacatttgagtttctacctgttggcttttatgaataatgttgatttgaatgtttgtgtacaagtatgaatacctgttttcaggtctcttgagtatatagttgctaggtcatatagtaactctgtgtttaacattttgaggaattgcccgactatttaacaaggtatatgtactgttttacaccagtaacatatgagggttccaatatctccacatccttgacaacacttgttactgtcctttttattgtagccatcctagtggctatgatgtggtatctcattgtggttttgatttgtgtttctctgatgctgatgatgttgaacatgttttcatctgcttattggccatttacatatatcttcttaagaacggttacccatttacagtatggaaaatgcttcagatgcaactctagtcatgccttagagatggagctttattaaacattcagatctctaggcatatgaagtgctgagttctcttgaactcctaatacagattgcactgagtttagtgataccttttctggagcattcctgagttcaggtagggagaagggtttttgctgtgattggcttgttatgttctttctaaatggaaatagaattgaagtgtctcctctctccatttattggaagagtcatgagggacataattagatgatcccttggagtctccggcttaggtcagtggttatctacttaggctgcacattggaatcacctgagagttaaaaaaccaggataacctctgcctgtgtctcatctccagcaattctgatgtaattggtcagggctgtggcccgagtaggtgagttctggttttttaaagctcccaggtgattctgatgtgcaatccaggttgagatcactttgggccctttccagctctttaaacatatatatttatctaggaaggtatgaaagcataagttttcttgagactgcctttaacatctgtaaaggctttcaaagcagcttctgtagttttttttaaatggctgaatatttttcaacaggcagcatttgggttataaaattagcttttggtagagttgacttataccacctccagcttttgttccaaaaataaatactggttcttttggcacactagttgttttaccctaaagttcctctttgtaagccagttattaaaagttgtgatgcagccagggcgaagtggtacacatctgtagtcccagctactcggaaggctgaggggggaggatcgctagagcccaagaagtcaaggctgcagtgaactgtgattacaccactgcactgcagcctgggccacagagcgagactcatctctttaaaaaaaagaatgttgtgaggccgggcgcagtggctcacgcctgtgatcccagcactttgggaggccgaggtggacggatcacctgaggttgggagttcgagaccagcctgaccaacatggagaaaccctgtctctactaaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctcaaaaaaaagaaaagaaaagaaaagaatgttgtggccaggcgcggtggcttacgcctgtaatttcagcactttgggagaccgaggtgggcggatcacgaggtcaggagatcaagaccatcctggctaacacagtaaaaccccatctctactaaatacaaaaaaaaattagccgggagtgctggcgggtgcctgtagtcccagctactcaggaggctgaggcgggagaatggcgtgaacccaggaggcagagcttgcagtgagcggagatcgcgccactgcactccagcctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacaaaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtgaaaccccgtctctactaaaaaatagaaaaaattagctggggtggtggcgggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaa

SEQ ID NO: 5886 - DNA, 38290 bp, human
cctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttggcctcccaaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaaaaggtaggaaaaggaccaaccagatcagcagagaagagttgccttggagttttcttttagttttctgcagttcattagatagtaactaggccatgtcattttactcccttgtagtgaagatatgttgaagttgtactggtatactcttctacctttctgtaattttatattgtgtagacttgataaaatttatgtgtcaatcaccaccattaatatcaatattgagcctcaattcttatttttctgcccagtggctgccaaattactaacatttacaataattcactactactaagataatctactagttcgatcacatacttcaaattgttatggaactactgtcttcagcattgtgcttctgataactgataagtataattttttttttgtccagagtgaacatgtctattcttccactgtacacactaataaaaggaaaaattgtaatattgggtaaattcatgtccttacacatgtagtagttatgagcccatgtccctagaatgagtaataatttatccctcccttggttgaatagtcaagaatgctgattttaattcttctaacagctttatccctcagaagggaaggcaagcaagttatatatgtagtttatttgtaagactgatatgaaattggaagatgaatctactattagctttaattatttttacatttaggaatattgcatcagtaactcataattttggttttctgttatcctgagttaacacaaattatccaaggagatggcggatcatctgctttgaggtgtttttttttgagaattttaatgtatctgaatataaaaggtaaaaatatgccaactagcaatttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcgattatagcaaaagtattgattttcattccagacaaaagtcagaatgaaaggtaatttctcaatactctttcagattaataaaagtacctgtagcgatttttatcattcacaagtatatcacaagtaagttagaatttgagaactgtgttctagatctctgaggagatgcagtcagatttctgaactgtctcagcaaatggtaagtaacttagagctagtaattaataacctgtcctttgatttctgattcagccaagaatggccatatttgggaaaggcagatctggagagtaaccacgttttcattcatttaccacttctaggcccctccagagctctcagatattttggggttgagcccttccccaaagccatacaggaccttttttttgtgatctgttctagccatttttatgttgggtgcttgttatggactgagcatttatgtcctcccacaccccccccataccttttttgaagtcctaacccccagtgtgatggtatttggagacagggcctttggaaggtaattacagttagaagaagtcgggagggttgggcccaggtctgattggattagtgcccttatatgaaaagacaccaggacgggcgcagtggctcacacctgtaatcccagcactttgggaggccaaggtgggtggatcacgaggtcaggagtttgagaccagcctggccaatgtagtgaaacaccatctctactaaaaatacaaaaattagctgggtgtggtagcgggctcctgtcatccaagctactcgggagggtgaggcatgagaatcacttgaacccgggagttggaggttgcagtgagcccagattgtgccactgtactccagcctgggtgacagagtgagactctgtctcaaaaaagaaaaaaaaaaaaaaagagacaccagagagcttgttagaagaggtcatgtgagcacacagttagaagaccttcaagccaaagaagaggcctgagattgaaacctaccttgcaggtaccttaattttggacttcccagcctccaaaactgtgagaaataagtttctgttaagtcactcagtctgtggtattttgttatggcagcctgagcaggtagttgttctttcagaaggtgttgataataaccacatgcaacaccaagtcacaaataataaaacagatgtaacttatattcatacagaaagttgggcactgccattgccttgttggtttacacggctgtgctagttcagtagcagaaaggtgctggtctcctttactcagtttacaatctaggcagtagaatgtaatcactgctttaaacttgatactgcttagggagagaatcattggtgctgggtaactttgggttctaggtttactttttgtgtatatataactgtttttggtaaatcacaagtttctgggcttgtcgaattagattttgttacagattatgagctttattatgctatacagttagttgtatgtatatatgcctttcccactagattttaagctttttttttttttttttttttgtgacggagtcttgctcttgtcgcccaggctgaagtggagtgcagtggcacaatctcggctcactgcagcctccacctcctaggttcaagcgattctcctgcctcggcctcccaagtaactgggactacaggcacgtgccaccacacccggctaatttttgtattttttgtagagacagggtttcgccatgttggctaggctggtcttgaacttctggcctcaggtgatccacccgcctcagcctcccaaagtgctgggatttacaggcatgagccaccacgcccagctataagctctttaagggttgtaaatttataatcattcttttactctcctgcaaattctgttgcacactgccttaatcaaggtagatgctgaatgcatttttgtataattgaatatgttgcaatccccaactctctccaactgttcctgtcaaagcagccactggattgttaactaatccatattagatggggttaattaatatcagatgggacaagtaagggctaataagattataggccaccaagtagatttctgtctagctcttatagagattgagtttattggacctgtttgataggaagttttggtgtttgggatgattaaaactgaagttcctatttattgaattatacctatttatattatttcatatcagtggtccacatgcaagtgaggcttctgagacagagtttgagttctctcttcaactaccataacacttaacctgtatctttttttttttttttttttttagacggagtctcgctctgtcactcaggctggagtgtagtggtatgatctcggctcactgtaacctctgcctcctggattcaagcagttctccatgtctcagcctccctagtagctgggattacaggcctgtgccaccatgcctggctaattttttttttgtatttttagtagagacggggttttaccacgttggccaggctggtctcgaactcttgacctcgagcgatcaacttgccttggcctcccaaagtgctgggattacaggcatgagccacagcgcccagccgtctttttttttaaatagcaatttaacactgttcacagttactcatgtacatgtcatgccatctattacactgtaagttctgtgagggtagctgtatcaaatttatctaactctctctagtatgcatgacatagtaagtattcaataaatatttgcatattagtgataaggatacaggttctgaatagtgggtccttaccatttaagaattagtatttgatggccgggcggggtggctcacgcctgtaatcccagcactttgggaggctgaggcgggcggatcatgagatcaggagatcgagaccatcctggctaacatggtgaaatcccgtctttacaaaaaaaatacaaaagaattaaccaagtgtggtggtgggtgcctgtagtcccagctactgctttgtgaggctgaggcaggcagatcacctgaggtgggaaattcaagaccagcctgaccaacatggagaaaccccatctctactaaaaatacaaaattagccgggcgtggtggcgcatgtctgtaatcccagctactcgggaggctgaggcaggagaatggcgtgaacccgggaggcggagcttgcagtgagccaggatcgcgccactgcactccagcctgggcgacagagcgagactccgtctcaaaaaaaaaaaaaaaaaaaaaattagtatttgatatttgatcattaaatatgaattaagaggacttagactttttgttaaatgtcaagctgggaaaagttgtcatttaaatgaattgcctcttatttaatttcgtctgatgatacattttgtttttattttgtaaaaaattattttttttctttttggagacagggtcttgctctgttgcccaggctggtcacaaactcctgacctcaagcaatcctcctgccttagcctcccaaaatgctgggattacaggcgtgagccacctcgcccggccttgtattatgatacattttgaacaactacaagtagacttggtataatgaacctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaagagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaaaaaaatttagaatatatagcaaagcaataaagaactaaataaaattgctgtaactcctctttcaaagataagtgcttttatgattttgttgtatttttttctgtatataggtacatatatagtatttataaagctgtactcatagtacattttcacatcacaggtaccatatcagtgttattaaatattttgtatgccaggggctagacataccaagacaaccaatatgtggttctacttaaataatattagagtatcttttatgatgacacttcatgagttgactataataatcttagacttctaagagtttgggttttcaaaagatcacttagcttttttgggtgatttttcccccttactgtgagatgagagaggctgtttggatttgggattggggtagcggggacagcaacttttcttttctttttcttttttattttgaggtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccaccacaccatgccagtttttcctgttcagtgtgatattttatcttgttagactacagtgtgttaaaacttgttttactaaattttcaaacatactcaaaagtggagagaatagtataatgaatacccgtatgttcatcacccatgtttagaatattattaaatataaagattttgctgcgtttgtcttagctctttaaaatttttctttttctctttgtgacctaaaggaaattccatatcttatcactttacttctacattcttgactaagatgactaagacatatagttacatggttttttgttttgttttttgttttttaaagacgaaatctcgctcttgtcccccaggctggagtgcaatggtgccatctcagctcagtgcaacctctgccttctgggtacaagcgattctcctgcctcagcctcccaagtagctgggattacaggctcctgccaccacgcctggctaatttttgtatttttagtagagacggcggggggaggtttcaccatgttgacaaggctggtctggaactcctgacctcaggtgatccacccgcctcggcctcccaaagtgctgggattacaggcgtgagccaccgcgcccagcctgtttttttgtttgtttgttttgttttttttgagacagagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaacaagaagactaaagttctctcctttcagccttctgtacacatttcttctcaagcactggctatgcatgtatactatatgcaaaagtacatatatacatttatattttaacgtatgagtatagttttaaatgttattggacacttttaatattagtgtgtctagagctatctaatatattttaaaggttgcatagcattctgtcttatggagataccataactgatttaaccagtccactattgatagacactattttgttcttaccgactgtactagaagaaacattcttttacatgtttggtacttgttcagctttattcaagtggaatttctgggtcaaggggaaagagtttattgaatattttggtattgccaaattttcctctaagaagttgaatcattttatactcctgatgttatatgagagtacctttctcttcacaatttgtctcttttttttttttttttgagacaaggtctctgttgcccaggctggggtgcagtgcagcagaatgatcacagttcactgcagtctcaacctcctgggttcaagcgatccttccacctcagcctcctgagtagctgggactataggtgtgcgccaccactcccagctaatatttttattttgtagaaacagggttcgccatgttacccagcctcccaaagtgctgggattacaggcatgagccactggcccagtttctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactgtattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccacagtctgcctgtgtcacacaattgaaatgcatcacaacattgacactgtggatgaaacaaaatcagtgtgaattttagtagtgaatttcattcataatttgatcgtgcaaacgtttgatttttattactttagactattgtttctgattttatgttgggttggtatttcctgtgagttactgttttcctttaaaataggaatttttcatactcttcaaagattagaacaaatgtccagtttttgctgtttcatgaatgagtcctgtccatctttgtagaaactcgccttatgttcacatttttattgagaataagaccacttatctacatttaactatcaacctcatcctctccattaatcatctattttagtgacccaagtttttgaccttttccatgtttacatcaatcctgtaggtgattgggcagccatttaagtattattatagacattttcactatcccattaaaaccctttatgcccatacatcataacactacttcctacccataagctccttttaacttgttaaagtcttgcttgaattaaagacttgtttaaacacaaaatttagacttttactcaacaaaagtgattgattgattgattgattgattgatggtttacagtaggacttcattctagtcattatagctgctggcagtataactggccagcctttaatacattgctgcttagagtcaaagcatgtacttagagttggtatgatttatctttttggtcttctatagcctccttccccatccccatcagtcttaatcagtcttgttacgttatgactaatctttggggatttgtgcagaatgttattttagataagcaaaaacgagcaaaataggggagtttaactttaatattttcttttaaaaagcatttcatgttataagatcaattctgagtggtagaaatgctttgacattttatttccattttctacttttagtttttttcctatttgtttaagatcttagaggattattaagctgaactcctcaactgataaaaagcatgacatcttaaacataagcaaagcatatttttaggttaattttcacatagaaaacagtttattttatgtgaaattctatgtagatatactatttttttggtatttattgatatgtttattttattttattttattttattttattttattttattttatttatttatttttttttttgagacagagtctcactctgttgcccaggctggagtgcagtggcatgatcgtagctcactgcaacctccacctcccgggttcaagcaattcttctgtctcagcctcccgagtagctgggactacaggtgcctgccactatgcccggctaatttttgtgtttttagtagagatggggtttcaccttgttggtcaggctggtctcgaacccctgacctcaggtgatccacccacctcagcctcccaaagtgctgggattataggcatgagccaccgtgcccggccgacatgttaattttttaaaaaaggctttactggggtatattttatataatataataatcacatgttttaactatacaattccaagctttttagtatatttatagggctatgcaaggaagatatactgttaaacagtagaaattgagaaagctcttctgataatatctcttgatttgatgatggctcatgcctgtaatctcagtgctttggaaggccaagacagcagaatcacttgaggccaggggttcgagaccagcctgggcaacacagcaataccctatctttacaaataataaaaatatctgttgatttgaagtaaagtttttttttaaagacaaggtctcattctgtcacccaggctggaatgcagtagcaagatcacagctcactgtggccttgaccttctgggctcaagtgattctcccacttcggcctcccgagtagctgggactaacaggtgtgcaccaccatggctggctaatttttttttatgtttgtagagattgggtcttactgtgttgcccaggctgatcccgaactcctgggctcaagcagtcttcctgcctcagcctctaaaattgctgggattacaggcttgagtcaccatgcccagcctgaagtagcatttctaccctgtttaataattcagcagcttgtcatgtaagatattcatatatgcatataaaacattaggcagcttaatttggtaaaactgtaaaatggaaattttaaattgtttgcagcatcaataacattgatgtcagtatgatttttacatgctgatcttgaccaatttgaaacagtgagttaaaatctggctgatccgtactaatcctaaagaaatattctatgaactattaaatgtttccagaatatataaagaaacattatgatgtcaacacacccatctatttttttttggaaataaaaactccatttttcttattaaagaaaacatgcttattagaaaacatacggctgggtgcagtggcacacatgtaattccagtgctttgggagatcgaggtgggagaatcacttgaggccaggagtttgagaccagcctagacaacataatgagaccccctctctacacaaaaagaattagttgtgcatggtggcgtgcacctgtagtcccagctacttgggaggcagaggcaggagcatcccttgagcctaggagtttgagactgcaggagttcgagactgagtggaatgcagtggaactgcattccagcctgagtgacagagggagaccctgtcttaaaaaaataagaaagaaaacacaactgcagaaaattataaaggatttaagtcattccaaatatcactgccactttttatttagaatattctaaagaattctctctctgtgtacacacacacatatgcgtactcttaatccaagtagcttggtaggattttatttacctagtgcctagatgggaaattgcctggggattccaaatacctatttcattaaattaaagatgtcactgattttaagacttaacactatttttcatactgccaagaaagaaaacactaccagttataaatgtaaattgccatcaattgtaatacatcaattttagagctattattaataaaatgtgaatgtgcatcttagagcaatgaaatatagtactatatatttgatgaccttttctgccctgtgatattcagaaagtgaaagttaaatatgggctgagcatggtggctcacacctgtaatcccagtactttgggaagtcaagacgggaggctggcttgaacccaggagttcaagaccagcctaggcaatgtagcgagacgccatctcaaaatattaaaaataagtaaataagtaaataaaaagaaggttaagtatacaaatgtatttcctttgttgtgaatttatttcaattttatagtgattttttttttttgagacgaagtctcactcttgtcccccaggctggagtgcgatggcgtgatctcagctcactgcaacctctgcctcccaggttcaagctatactcctgccttggccccccgagtagctgggattacaggcgcctgctaccatgcctggctaatttttgtatttttagttgagatggggtttcaccatgttggccaggctggtctagaactcttgacctctggtgatccacccgcctcggactcccaaaatgctgggattacaggcgtgagccaccgtgcctggccagtggttttttgttgttgttgttgttgttgttttgtttttgtttttgtttttgttttgagacaggatcttgctctgtcacccaggctggagtgcagtggtgccatcttggttcactgcaacctctgcgtgggctcaagcaatcctcccacctccctttccagagtagcggggaccacaggtgtgtgccaccacacctgactaatttttgcatttttttttgtagaaacagggttttgccatgttgcccaggttggtctgaaactcctgagctcaaacaatccaactgccttggcttccctaagtgaaattacaggcatgggccactgtacccagtctagtgatttttttatttttatttttattttattttattttatttttttaccaaaaaaacaacaaagcctcaggaggaaaagttgatacacaagtaaattttattggaaatgtttttgtgtggaccttaagcagagggaaaattagtctgcattatggtgtatccagactaaatgactgatattaaaatgaaattattcttaggatttgcaatcttagagaaaactttttcatttttatttttttgagttacaaattatcttcatttacatttgagaacagtgagtcacagagggattaagtaacttactcaagatcatacaagtctttgatttgaacccaatcttttaactctgcagaactcagagtcactcttatttggaaaaactttttaactgatgtggatcctctaatatgggcttcctattattcattctctattagtcagaagttttgcaagcagacagaattcattttgccaattacgggattttccctcagttgcagtcaaggttcataaaactataactctttatctttaattagaaatgtttttttttttgagacaaggtcttgctctgttgcccagactggaatgcagtggcatagtggcccattgcagctttgaactcctgggctcaagggatcctctgcctcagcctcccaagtatctgagactacaagtgcgtgccatcacccatggctattttaaaaaaaaaaaaaattgtagagatagggtcttgctgtgttgcccaggctggtctcaaactcctggtctcaagcaatccttctgccttggtctcccaaagtgctgagattacaggtgtcagccgttgcacctggccaaaacgataacttaaaatacacacacacacacacacacacaaacacatatgtgtatttgtgtgtgtgtgtgtgtgtgtgtgtctcaaaaggtatcaaaagagaatagctataactttagtgttgatcttgatagtgacttgattaggctctgtttaacatcaaagatgcaaattaatactttctttgaacatattaaaaatgcagaaaatattggagtattttattttaaataaattgtattctgtatatttaaggtatacaacatgatgttatgggatacatataggtggttaaaagattactgcagtgaagcaaattaacgtatccctcaactcacatagttacccattttttttttgttttggtggcaagaggagcttaaaatctcatttagtgtgaatcccaaatacagcacaattttattacctatatacttcatgttgtacattatatttctagacttgttcatcctacatatctgctactttgtatcctctgagctacatctccccattttctcacttgccccccaagtagtttcttaaagtgtctcatgtaagagggcagtagctttcagcttaaactttttctctgtatgtagtcgatttctttgaggtatacttttctctccagaatagttagatgtaggtataccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttgaatgtttgaaaatagtgtacttaaaaataccaggtggtttttgtttgttttttgtttttttctttttttgagacagggtctcactctgtcacccaggctggagtgtagtggtgcaatctcatctcattgcagtcttgacctcccaggctcaggttatctcccacctcagcctcccaagtagctgggactacaggcacatgccaccacgcccagctaattttttgtattttttgtagagacggggtttcaccctgttgcccaggctggtctagaactcctgggcttaagcgatcctcccacctcagcctcccaaagtgctaggattacaggcatgagccaccatgcctggcagaaaataccaggtttttaagtatcagcacttactcttcaatcttttctattactatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacattaagggtatgtgtttgtagtcccaaagagcttctctggcaattttatgtagttgacagtgacgctctgagttcaggacagattggactccttggctgagaggagtgaggagataggacggtagaggagagggtagagcaactctggaggaagctttcccctcacctttgccagtcctgttatcctagacttaaccataattaaagatgagggaggcactcagtaaagggatctagtgggaagcttgttccagacagccaaggagggaggttcgcgcagttcctttggccacccaggtggggtaattgatccatgtatgccattcatgtacaatgtaggcacttatacctgtattccaatgtagtgaactataccattactcttaaattaatattctttattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgattagggtgaggttgataatagcagccatagagttaagaggattaagtgctataatgcaagtagagctcttacaacagtttctggtaaatcactcaataaattcagacatactattattttaagaaatctcaaagagttttcttgtaccttaaaattctcctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactcgttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattatatatgatttatggtaataataatatatatgttacaaaatacatacaaaaatatagattaaacaaggtgaggtaaaaaatttaaaagttctaatctttcttgcaaaccagtggatcttttgtgccttactctggtaaacactgtcttagaagaatatatagaacattaaaatcttaatgctatagttatatgacagagtatgatgagagctacagataaacaacacatcatgaatcttcttgtggcagtgtttataaccattatgtgaaatgctgcctcattcttataactagcataagaacagataggactttctcgattttgaggggtaattattagatggtattttctgttaaggactcttccagctataaaattcttaaatgtagaaagcgaagtgagggtttatggtgagaggaagcattggtatcatgttttagtgtagtccaagaatatggacacatccagaaaatgcagatcaagtttagcctaatgagaaaatatattttggagtccatatggtaaattaaattatgtgatttttgagttattgtacaaatataattcttagaatgttagagtcaggagactataagagaccaactgcttcaagtttcatttaacacatgggaaactaaggccagagaaatttcaagacttgcccaagattagacctcttgttaagtaatgaaagtgttttaaaaacaggtgggtcaaattctgtttttaaaatttccattatgatgaaaatttcagtattacaggcttccaaatcccagcagatgggccacttgtttaaaggagagtttgatataataaagcatctaaaaacaagagtttggataattccttagggttgttatgatgtgatttgacttataattggaaataccgttttattcattgtactgattttcatttctctttttcttctagaatgtcttgattgtggaagtaagttcacatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgttaggttgtttccactgtttgctccttatttctcgtacctgaaatgtccttattccctcccttcttatcccatgtttaagtcatttaagacccagctcaaacgtcacctccacaaaaccttccttgatacccctttcctcttcaattcacttggaccttttgcatttaattttaatttttattttttttaagacagagtctcactctgtcaccaggctggagtgcagtggtatgatctcagctcactaactactctgcctcccaggttcaagcaattctcatgtctcagcctcccaagtagctgggactacaggtgtgcgccaccatgcctggctaattgtgtgtgtgtgtgtgtgtatgtatgtatgtatatatgtgtgtgtgtgtatatatatatatacacacacatatataaatatatatacatatatatatatacacacatatataaatatatatacatatatatatatacacacacacacacatatatatatatatagttttttttttttttaagtagagatggggttttgccatgttggccaggctggtctggcctcaagccatcctcccacctcggcctcgcaaagtgctggtattataggcatgagccactgtgcctggcctgcatttcattttaattataaaatattttgaactcagaaaaaagggtatgctgaatacctacgtacccacaaaagtattaacattttgccatatttgcttctgatcttattttttttgagaaattaaagatcataatacaactaaagccccatttctttcccttcattcccagaagtatgacaattatccttaaagttgatatatatcattcccatgcatgttttttatacttccctagtacaagttagctgtatcctctgctcaggggctcatcaagctgaatcaagggactcatgatcctcttcaaagttccttcaggttgttggcagaatttagttccttgtgattgtaggactgagggcccgttttctcactggctgctggccaggggttgctcccagatatttaaaggctcatgccctagcccatgacagtctcacaacatggcagctgacttcttcaaaaccagcaggagaatcttgctctagtctaccacataacctaatcacaggagcggctatcccgttattttcacagatcctggtcacattcaaggggagggaacccttctgtgtgtgtacaccaggaggcaggaattttttttttctttttcttttttgttaaaaagtcttaaagtcttttatccctaaaggaggcaggaattttgagagccatcagaattctgcctaccacagcccagaaatctgcatttttcacaagtctccagccatgatgtttctgatggctcacactgctttattccatttttaaagagtatttttattgaaaagcattagggttatggtttaaaaaatattttccctaacaaagatgggtttgtttagagtcctacttttgactaaatagctgagattcacttttatgtaaagtcattttatagcgttattaatttgggtgcctttaaaaatagtataaagcatgtttctcgagtgtagtctgttagccacctatattggagagttgggaggagagagtctctatcttgaatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaatgtcaacctactgtggcatagactttaatcctctgggtattcttttgttgttctttcctggtatatgctgtggaattgagatagactggttcgtgagcgagagattttgtgttgccacaggtaggacatgctcaaacaatacttgggtcatttcttgacccaagtcatctattcaccatagttttgtagcaccgatcttgcatacatttcatgtatcttctttgaaccccacgtcagtgctgcttatatgatactcagaaattaaacactaaggaataagattttcaggtaggattgagttttggagggtcacaaatcttgtaatgtctaatatttccactctccctgctgagaattagttttggcttccttggaggtgatatcgcctctgttgagtataagtggcctactgtgatcacaccactgcactccagcctgggtgacagagtgagaccctgtctcagaaaaaaaaaaaaaaaaaaagaatgcatggcctagatgacttctaaggtttttcccacccagttccagttttcatgttctaggcagagcagtaaagtgagaaacacatggacttgggagtttagtctcgcatttcactgccacttaatctgagcgactattccatatttaatctctctgaatgtatttactcatctttaaaggggaatgattattaacatctttttctcagggaaactatatgagtcaaggagataatatatttgaaaatctttttaactgcaaagcgctgtttcactgttggttataatgtgattgatctcattgtagtgagcagctgcttaattgcgttttagaatgtagggaagatagtaatatttttcacattatatatgtagctggttctggaactgtaaacatactccttttttatggagatctgagtcacgtaccataaaattcactcttttaaagttgtacaatccagtggtttttgatatattcagagttgtgcatctgctaccactatttcattttggaacccaaagaaaccttgtacccattagcagtcattctcccttctcccagcccctggcaactactaatctactttctacagaaagtccgtacagatttgtgtattatggacattccatataaatggactcatgcaatatcctgtcttctttcacttagcatagtgttttcaaggttcatctaggttggggcatgtatcagtacttcatcccttgttttggctgaataatatttcattgtacaaatatatcacattttgcttatccatctgttggtgaacatttgagtttctacctgttggcttttatgaataatgttgatttgaatgtttgtgtacaagtatgaatacctgttttcaggtctcttgagtatatagttgctaggtcatatagtaactctgtgtttaacattttgaggaattgcccgactatttaacaaggtatatgtactgttttacaccagtaacatatgagggttccaatatctccacatccttgacaacacttgttactgtcctttttattgtagccatcctagtggctatgatgtggtatctcattgtggttttgatttgtgtttctctgatgctgatgatgttgaacatgttttcatctgcttattggccatttacatatatcttcttaagaacggttacccatttacagtatggaaaatgcttcagatgcaactctagtcatgccttagagatggagctttattaaacattcagatctctaggcatatgaagtgctgagttctcttgaactcctaatacagattgcactgagtttagtgataccttttctggagcattcctgagttcaggtagggagaagggtttttgctgtgattggcttgttatgttctttctaaatggaaatagaattgaagtgtctcctctctccatttattggaagagtcatgagggacataattagatgatcccttggagtctccggcttaggtcagtggttatctacttaggctgcacattggaatcacctgagagttaaaaaaccaggataacctctgcctgtgtctcatctccagcaattctgatgtaattggtcagggctgtggcccgagtaggtgagttctggttttttaaagctcccaggtgattctgatgtgcaatccaggttgagatcactttgggccctttccagctctttaaacatatatatttatctaggaaggtatgaaagcataagttttcttgagactgcctttaacatctgtaaaggctttcaaagcagcttctgtagttttttttaaatggctgaatatttttcaacaggcagcatttgggttataaaattagcttttggtagagttgacttataccacctccagcttttgttccaaaaataaatactggttcttttggcacactagttgttttaccctaaagttcctctttgtaagccagttattaaaagttgtgatgcagccagggcgaagtggtacacatctgtagtcccagctactcggaaggctgaggggggaggatcgctagagcccaagaagtcaaggctgcagtgaactgtgattacaccactgcactgcagcctgggccacagagcgagactcatctctttaaaaaaaagaatgttgtgaggccgggcgcagtggctcacgcctgtgatcccagcactttgggaggccgaggtggacggatcacctgaggttgggagttcgagaccagcctgaccaacatggagaaaccctgtctctactaaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctcaaaaaaaagaaaagaaaagaaaagaatgttgtggccaggcgcggtggcttacgcctgtaatttcagcactttgggagaccgaggtgggcggatcacgaggtcaggagatcaagaccatcctggctaacacagtaaaaccccatctctactaaatacaaaaaaaaattagccgggagtgctggcgggtgcctgtagtcccagctactcaggaggctgaggcgggagaatggcgtgaacccaggaggcagagcttgcagtgagcggagatcgcgccactgcactccagcctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgt

SEQ ID NO: 5887 - DNA, 9950 bp, human; identical to SEQ ID NO: 5054

SEQ ID NO: 5888 - DNA, 18356 bp, human; identical to SEQ ID NO: 5059

SEQ ID NO: 5889 - DNA, 63959 bp, human; identical to SEQ ID NO: 3774

SEQ ID NO: 5890 - DNA, 63894 bp, human; identical to SEQ ID NO: 3772

SEQ ID NO: 5891 - DNA, 62945 bp, human; identical to SEQ ID NO: 3770

SEQ ID NO: 5892 - DNA, 60900 bp, human; identical to SEQ ID NO: 3771

SEQ ID NO: 5893 - DNA, 59814 bp, human; identical to SEQ ID NO: 3775

SEQ ID NO: 5894 - DNA, 62781 bp, human; identical to SEQ ID NO: 3773

SEQ ID NO: 5895 - DNA, 5443 bp, human; identical to SEQ ID NO: 3897

SEQ ID NO: 5896 - DNA, 11173 bp, human; identical to SEQ ID NO: 3899

SEQ ID NO: 5897 - DNA, 1190 bp, human; identical to SEQ ID NO: 3898
